US008816056B2

(12) United States Patent
Swayze et al.

(10) Patent No.: US 8,816,056 B2
(45) Date of Patent: Aug. 26, 2014

(54) MODULATION OF SIGNAL TRANSDUCER AND ACTIVATOR OF TRANSCRIPTION 3 (STAT3)EXPRESSION

(75) Inventors: Eric E. Swayze, Encinitas, CA (US); Susan M. Freier, San Diego, CA (US); Robert A. MacLeod, San Diego, CA (US); Youngsoo Kim, San Diego, CA (US)

(73) Assignee: Isis Pharmaceuticals, Inc., Carlsbad, CA (US)

( * ) Notice: Subject to any disclaimer, the term of this patent is extended or adjusted under 35 U.S.C. 154(b) by 76 days.

(21) Appl. No.: 13/436,558

(22) Filed: Mar. 30, 2012

(65) Prior Publication Data

US 2012/0277284 A1 Nov. 1, 2012

Related U.S. Application Data

(60) Provisional application No. 61/471,035, filed on Apr. 1, 2011, provisional application No. 61/558,308, filed on Nov. 10, 2011, provisional application No. 61/471,001, filed on Apr. 1, 2011, provisional application No. 61/471,045, filed on Apr. 1, 2011, provisional application No. 61/558,316, filed on Nov. 10, 2011, provisional application No. 61/471,015, filed on Apr. 1, 2011.

(51) Int. Cl.
*C07H 21/02* (2006.01)
*C07H 21/04* (2006.01)
*C12N 15/11* (2006.01)
*C12N 15/113* (2010.01)
*C12N 15/00* (2006.01)

(52) U.S. Cl.
CPC .............. *C12N 15/11* (2013.01); *C12N 15/113* (2013.01); *C12N 15/1135* (2013.01); *C12N 15/00* (2013.01)
USPC ..... 536/23.1; 536/24.5; 536/24.31; 536/24.1; 514/44 R

(58) Field of Classification Search
None
See application file for complete search history.

(56) References Cited

U.S. PATENT DOCUMENTS

| 5,686,242 | A | 11/1997 | Bruice et al. |
|---|---|---|---|
| 5,719,042 | A | 2/1998 | Kishimoto et al. |
| 5,801,154 | A | 9/1998 | Baracchini et al. |
| 5,844,082 | A | 12/1998 | Kishimoto et al. |
| 6,110,667 | A | 8/2000 | Lopez-Nieto et al. |
| 6,159,694 | A | 12/2000 | Karras |
| 6,194,150 | B1 | 2/2001 | Stinchcomb et al. |
| 6,248,586 | B1 | 6/2001 | Monia et al. |
| 6,514,725 | B1 | 2/2003 | Kishimoto et al. |
| 6,582,908 | B2 | 6/2003 | Fodor et al. |
| 6,727,064 | B2 | 4/2004 | Karras |
| 6,727,084 | B1 | 4/2004 | Hoyoux et al. |
| 7,235,403 | B2 | 6/2007 | Primiano et al. |
| 7,307,069 | B2 | 12/2007 | Karras |
| 7,820,722 | B2 | 10/2010 | Raoof et al. |
| 7,834,170 | B2 | 11/2010 | Khvorova et al. |
| 2001/0053519 | A1 | 12/2001 | Fodor et al. |
| 2003/0228597 | A1 | 12/2003 | Cowsert et al. |
| 2005/0196781 | A1 | 9/2005 | Robin et al. |
| 2010/0105134 | A1 | 4/2010 | Quay et al. |
| 2010/0298409 | A1 | 11/2010 | Xie et al. |
| 2011/0054003 | A1 | 3/2011 | Karras |

FOREIGN PATENT DOCUMENTS

| EP | 0676469 | 10/1995 | |
|---|---|---|---|
| WO | WO 96/16175 | 5/1996 | |
| WO | WO 98/30688 | 7/1998 | |
| WO | WO 00/61602 | 10/2000 | |
| WO | WO 2005/083124 | 9/2005 | |
| WO | WO 2008/109494 | * 9/2008 | ............. C12N 15/11 |

OTHER PUBLICATIONS

International Search Report for application No. PCT/US12/31642 dated Sep. 21, 2012.
Aberg et al., "Selective Introduction of Antisense Oligonucleotides into Single Adult CNS Progenitor Cells Using Electroporation Demonstrates the Requirement of STAT3 Activation for CNTF-Induced Gliogenesis" Molecular and Cellular Neuroscience (2001) 17:426-443.
Agrawal, "Antisense oligonucleotides: towards clinical trials" TIBTECH (1996) 14:376-387.
Akira et al., "Molecular Cloning of APRF, a Novel IFN-Stimulated Gene Factor 3 p91-Related Transcription Factor Involved in the gp 130-Mediated Signaling Pathway" Cell (1994) 77:63-71.
Barton et al., "Signal transducer and activator of transcription 3 (STAT3) activation in prostate cancer: Direct STAT3 inhibition induces apoptosis in prostate cancer lines" Molecular Cancer Therapeutics (2004) 3(1):11-20.
Braasch et al., "Novel Antisense and Peptide Nucleic Acid Strategies for Controlling Gene Expression" Biochemistry (2002) 41(14):4503-4510.
Branch, "A good antisense molecule is hard to find" TIBS (1998) 23:45-50.
Catlett-Falcone et al., "Constitutive Activation of Stat3 Signaling Confers Resistance to Apoptosis in Human U266 Myeloma Cells" Immunity (1999) 10:105-115.
Chin, "On the Preparation and Utilization of Isolated and Purified Oligonucleotides." Document purportedly located on a CD-ROM and contributed to the public collection of the Katherine R. Everett Law Library of the University of North Carolina on Mar. 14, 2002.
Crooke, "Progress in Antisense Technology" Annual Review of Medicine: Selected Topics in the Clinical Sciences (2004) 55:61-95.
Crooke et al., "Basic Principles of Antisense Therapeutics" Antisense Research and Application (1998) Chapter 1:1-50.

(Continued)

*Primary Examiner* — Jennifer McDonald
(74) *Attorney, Agent, or Firm* — Rebecca Barrett

(57) ABSTRACT

Disclosed herein are antisense compounds and methods for decreasing STAT3 mRNA and protein expression. Such methods, compounds, and compositions are useful to treat, prevent, or ameliorate hyperproliferative diseases.

17 Claims, No Drawings

(56) References Cited

OTHER PUBLICATIONS

Epling-Burnette et al., "Inhibition of STAT3 signaling leads to apoptosis of leukemic large granular lymphocytes and decreased Mcl-1 expression" J. of Clinical Investigation (2001) 107(3):351-361.

Ernst et al., "The Carboxyl-terminal Domains of gp130-related Cytokine Receptors are Necessary for Suppressing Embryonic Stem Cell Differentiation" J. of Biological Chemistry (1999) 274(14):9729-9737.

Gewitz et al., "Facilitating oligonucleotide delivery: Helping antisense deliver on its promise" PNAS (1996) 93:3161-3163.

Grandis et al., "Requirement of Stat3 but not Stat1 Activation for Epidermal Growth Factor Receptor—mediated Cell Growth in Vitro" J. Clin. Invest. (1998) 102(7):1385-1392.

Groothuis, "The blood-brain and blood-tumor barriers: A review of strategies for increasing drug delivery" Oncology (2000) 2(1):45-59.

James, "Towards gene-inhibition therapy: a review of progress and prospects in the field of antiviral antisense nucleic acids and ribozymes" Antiviral Chemistry & Chemotherapy (1991) 2(4):191-214.

Jen et al., "Suppression of Gene Expression by Targeted Disruption of Messenger RNA: Available Options and Curren Strategies" Stem Cells (2000) 18:307-319.

Karras et al., "STAT3 Regulates the Growth and hnmunoglobulin Production of BCL1 B Cell Lymphona through Control of Cell Cycle Progression" Cellular Immunology (2000) 202:124-135.

Konnikova et al., "Knockdown of STAT3 expression by RNAi induces apoptosis in astrocyoma cells" BMC Cancer (2003) 2(23):1-9.

Lamy, "Dysregulation of CD95/CD95 Ligand-Apoptotic Pathway in CD3+ Large Granular Lymphocyte Leukemia" Blood (1998) 92(12):4771-4777.

Liu et al., "Serine phosphorylation of STAT3 is essential for Mcl-1 expression and microphage survival" Blood (2003) 102(1):344-352.

Mahato et al., "Modulation of gene expression by antisense and antigene oligodeoxynucleotides and small interfering RNA" Expert Opinion on Drug Delivery (2005) 2(1):3-28.

Mahboubi et al., "Desensitization of Signaling by Oncostatin M in Human Vascular Cells Involves Cytoplasmic Tyr Residue 759 in gp130 but is Not Mediated by Either Src Homology 2 Domain-containing Tyrosine Phosphatase 2 or Suppressor of Cytokine Signaling 3" J. of Biological Chemistry (2003) 278(27):25014-25023.

Matzura et al., "RNA draw: an integrated program for RNA secondary structure calculation and analysis under 32-bit Microsoft Windows" Computer Applications in the Biosciences (1996) 12(3):247-249.

Milner et al., "Selecting effective antisense reagents on combinatorial oligonucleotide arrays" Nature Biotechnology (1997) 15:537-541.

Mora et al., "Constitutive Activation of Stat3 in Human Prostate Tumors and Cell Lines: Direct Inhibition of Stat3 Signaling Induces Apoptosis of Prostate Cancer Cells" Cancer Research (2002) 62:6659-6666.

New England Biolabs 1998/99 Catalog (cover page and pp. 121 and 284).

Niu et al., "Gene Therapy with Dominant-negative Stat3 Suppresses Growth of Murine Melanoma B16 Tumor in Vivo" Cancer Research (1999) 59:5059-5063.

Niu et al., "Constitutive Stat3 activity up-regulates VEGF expression and tumor angiogenesis" Oncogene (2002) 21:2000-2008.

Olie et al., "A Novel Antisense Oligonucleotide Targeting Survivin Expression Induces Apoptosis and Sensitizes Lung Cancer Cells to Chemotherapy" Cancer Research (2000) 60:2805-2809.

Reynolds et al., "Rational siRNA design for RNA interference" Nature Biotechnology (2004) 22(3):326-330.

Sanghvi et al., "Heterocyclic Base Modifications in Nucleic Acids and Their Applications in Antisense Oligonucleotides" Antisense Research and Applications (1993) pp. 273-288.

Scherer et al., "Approaches for the sequence-specific knockdown of mRNA" Nat. Biotechnol. (2003) 21(12):1457-1465.

Song et al., "Activation of Stat3 by receptor tyrosine kinases and cytokines regulates survival in human non-small cell carcinoma cells" Oncogene (2003) 22:4150-4165.

Tamm et al., "Antisense therapy in oncology: new hope for an old idea?" The Lancet (2001) 358:489-497.

Zhong et al., "Stat3: A STAT Family Member Activated by Tyrosine Phosphorylation in Response to Epidermal Growth Factor and Interleukin-6" Science (1994) 264:95-98.

Genbank L29277.1 *Homo sapiens* DNA-binding protein (APRF) mRNA, complete cds: http://www.ncbi.nlm.nih.gov/nuccore/L29277. Dec. 31, 1994.

NCBI Reference Sequence NM_139276.2. *Homo sapiens* signal transducer and activator of transcription 3 (acute-phase response factor) (STAT3), transcript variant 1, mRNA: http://www.ncbi.nlm.nih.gov/nuccore/47080104?sat=14&satkey=6009123. Mar. 27, 2011.

* cited by examiner

MODULATION OF SIGNAL TRANSDUCER AND ACTIVATOR OF TRANSCRIPTION 3 (STAT3) EXPRESSION

RELATED APPLICATIONS

This application claims priority under 35 USC 119(e) to Provisional Patent Application No. 61/471,035, filed Apr. 1, 2011, Provisional Patent Application No. 61/471,001, filed Apr. 1, 2011, Provisional Patent Application No. 61/471,045, filed Apr. 1, 2011, Provisional Patent Application No. 61/471,015, filed Apr. 1, 2011, Provisional Patent Application No. 61/558,308, filed Nov. 10, 2011, and Provisional Patent Application No. 61/558,316, filed Nov. 10, 2011, each of which is incorporated herein by reference in its entirety.

SEQUENCE LISTING

The present application is being filed along with a Sequence Listing in electronic format. The Sequence Listing is provided as a file entitled BIOL0142USSEQ.txt created Mar. 29, 2012 which is 672 Kb in size. The information in the electronic format of the sequence listing is incorporated herein by reference in its entirety.

FIELD

In certain embodiments provided are methods, compounds, and compositions for inhibiting expression of STAT3 mRNA and protein in an animal. Such methods, compounds, and compositions are useful to treat, prevent, or ameliorate hyperproliferative diseases.

BACKGROUND

The STAT (signal transducers and activators of transcription) family of proteins are DNA-binding proteins that play a dual role in signal transduction and activation of transcription. Presently, there are six distinct members of the STAT family (STAT1, STAT2, STAT3, STAT4, STAT5, and STAT6) and several isoforms (STAT1α, STAT1β, STAT3 α and STAT3β). The activities of the STATs are modulated by various cytokines and mitogenic stimuli. Binding of a cytokine to its receptor results in the activation of Janus protein tyrosine kinases (JAKs) associated with these receptors. This phosphorylates STAT, resulting in translocation to the nucleus and transcriptional activation of STAT responsive genes. Phosphorylation on a specific tyrosine residue on the STATs results in their activation, resulting in the formation of homodimers and/or heterodimers of STAT which bind to specific gene promoter sequences. Events mediated by cytokines through STAT activation include cell proliferation and differentiation and prevention of apoptosis.

The specificity of STAT activation is due to specific cytokines, i.e., each STAT is responsive to a small number of specific cytokines. Other non-cytokine signaling molecules, such as growth factors, have also been found to activate STATs. Binding of these factors to a cell surface receptor associated with protein tyrosine kinase also results in phosphorylation of STAT.

STAT3 (also acute phase response factor (APRF)), in particular, has been found to be responsive to interleukin-6 (IL-6) as well as epidermal growth factor (EGF) (Darnell, Jr., J. E., et al., Science, 1994, 264, 1415-1421). In addition, STAT3 has been found to have an important role in signal transduction by interferons (Yang, C.-H., et al., Proc. Natl. Acad. Sci. USA, 1998, 95, 5568-5572). Evidence exists suggesting that STAT3 may be regulated by the MAPK pathway. ERK2 induces serine phosphorylation and also associates with STAT3 (Jain, N., et al., Oncogene, 1998, 17, 3157-3167).

STAT3 is expressed in most cell types (Thong, Z., et al., Proc. Natl. Acad. Sci. USA, 1994, 91, 4806-4810). It induces the expression of genes involved in response to tissue injury and inflammation. STAT3 has also been shown to prevent apoptosis through the expression of bcl-2 (Fukada, T., et al., Immunity, 1996, 5, 449-460).

Recently, STAT3 was detected in the mitochondria of transformed cells, and was shown to facilitate glycolytic and oxidative phosphorylation activities similar to that of cancer cells (Gough, D. J., et al., Science, 2009, 324, 1713-1716). The inhibition of STAT3 in the mitochondria impaired malignant transformation by activated Ras. The data confirms a Ras-mediated transformation function for STAT3 in the mitochondria in addition to its nuclear roles.

Aberrant expression of or constitutive expression of STAT3 is associated with a number of disease processes.

SUMMARY

Provided herein are methods, compounds, and compositions for modulating expression of STAT3 mRNA and protein. In certain embodiments, compounds useful for modulating expression of STAT3 mRNA and protein are antisense compounds. In certain embodiments, the antisense compounds are antisense oligonucleotides.

In certain embodiments, modulation can occur in a cell or tissue. In certain embodiments, the cell or tissue is in an animal. In certain embodiments, the animal is a human. In certain embodiments, STAT3 mRNA levels are reduced. In certain embodiments, STAT3 protein levels are reduced. Such reduction can occur in a time-dependent manner or in a dose-dependent manner.

Also provided are methods, compounds, and compositions useful for preventing, treating, and ameliorating diseases, disorders, and conditions. In certain embodiments, such diseases, disorders, and conditions are hyperproliferative diseases, disorders, and conditions. In certain embodiments such hyperproliferative diseases, disorders, and conditions include cancer as well as associated malignancies and metastases. In certain embodiments, such cancers include lung cancer, including non small cell lung cancer (NSCLC), pancreatic cancer, colorectal cancer, multiple myeloma, hepatocellular carcinoma (HCC), glioblastoma, ovarian cancer, osteosarcoma, head and neck cancer, breast cancer, epidermoid carcinomas, intestinal adenomas, prostate cancer, and gastric cancer.

Such diseases, disorders, and conditions can have one or more risk factors, causes, or outcomes in common. Certain risk factors and causes for development of a hyperproliferative disease include growing older; tobacco use; exposure to sunlight and ionizing radiation; contact with certain chemicals; infection with certain viruses and bacteria; certain hormone therapies; family history of cancer; alcohol use; and certain lifestyle choices including poor diet, lack of physical activity, and/or being overweight. Certain symptoms and outcomes associated with development of a hyperproliferative disease include a thickening or lump in the breast or any other part of the body; a new mole or a change in an existing mole; a sore that does not heal; hoarseness or a cough that does not go away; changes in bowel or bladder habits; discomfort after eating; difficulty in swallowing; unexplained weight gain or loss; unusual bleeding or discharge; fatigue; metastasis of one or more tumors throughout the body; cardiovascular complications, including, cardiac arrest and stroke; and death.

In certain embodiments, methods of treatment include administering a STAT3 antisense compound to an individual in need thereof. In certain embodiments, methods of treatment include administering a STAT3 antisense oligonucleotide to an individual in need thereof.

DETAILED DESCRIPTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference for the portions of the document discussed herein, as well as in their entirety.

Definitions

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Where permitted, all patents, applications, published applications and other publications, GENBANK Accession Numbers and associated sequence information obtainable through databases such as National Center for Biotechnology Information (NCBI) and other data referred to throughout in the disclosure herein are incorporated by reference for the portions of the document discussed herein, as well as in their entirety.

Unless otherwise indicated, the following terms have the following meanings:

"2'-deoxynucleoside" means a nucleoside comprising 2'-H furanosyl sugar moiety, as found naturally occurring in deoxyribonucleosides (DNA). In certain embodiments, a 2'-deoxynucleoside may comprise a modified nucleobase or may comprise an RNA nucleobase (e.g., uracil).

"2'-O-methoxyethyl" (also 2'-MOE and 2'-O(CH$_2$)$_2$—OCH$_3$) refers to an O-methoxy-ethyl modification of the 2' position of a furosyl ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" means a nucleoside comprising a substituent at the 2'-position other than H or OH. Unless otherwise indicated, a 2'-substituted nucleoside is not a bicyclic nucleoside.

"5'-methylcytosine" means a cytosine modified with a methyl group attached to the 5' position. A 5-methylcytosine is a modified nucleobase.

"About" means within ±10% of a value. For example, if it is stated, "the compounds affected at least about 70% inhibition of STAT3", it is implied that the STAT3 levels are inhibited within a range of 63% and 77%.

"Active pharmaceutical agent" means the substance or substances in a pharmaceutical composition that provide a therapeutic benefit when administered to an individual. For example, in certain embodiments an antisense oligonucleotide targeted to STAT3 is an active pharmaceutical agent.

"Active target region" or "target region" means a region to which one or more active antisense compounds is targeted. "Active antisense compounds" means antisense compounds that reduce target nucleic acid levels or protein levels.

"Administered concomitantly" refers to the co-administration of two agents in any manner in which the pharmacological effects of both are manifest in the patient at the same time. Concomitant administration does not require that both agents be administered in a single pharmaceutical composition, in the same dosage form, or by the same route of administration. The effects of both agents need not manifest themselves at the same time. The effects need only be overlapping for a period of time and need not be coextensive.

"Administering" means providing a pharmaceutical agent to an individual, and includes, but is not limited to administering by a medical professional and self-administering.

"Amelioration" refers to a lessening of at least one indicator, sign, or symptom of an associated disease, disorder, or condition. The severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antibody" refers to a molecule characterized by reacting specifically with an antigen in some way, where the antibody and the antigen are each defined in terms of the other. Antibody may refer to a complete antibody molecule or any fragment or region thereof, such as the heavy chain, the light chain, Fab region, and Fc region.

"Antisense activity" means any detectable or measurable activity attributable to the hybridization of an antisense compound to its target nucleic acid. In certain embodiments, antisense activity is a decrease in the amount or expression of a target nucleic acid or protein encoded by such target nucleic acid.

"Antisense compound" means an oligomeric compound that is capable of undergoing hybridization to a target nucleic acid through hydrogen bonding. Examples of antisense compounds include single-stranded and double-stranded compounds, such as, antisense oligonucleotides, siRNAs, shRNAs, snoRNAs, miRNAs, and satellite repeats.

"Antisense inhibition" means reduction of target nucleic acid levels or target protein levels in the presence of an antisense compound complementary to a target nucleic acid as compared to target nucleic acid levels or target protein levels in the absence of the antisense compound.

"Antisense oligonucleotide" means a single-stranded oligonucleotide having a nucleobase sequence that permits hybridization to a corresponding region or segment of a target nucleic acid.

"Bicyclic sugar" means a furosyl ring modified by the bridging of two atoms. A bicyclic sugar is a modified sugar.

"Bicyclic nucleoside" (also BNA) means a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring.

"Cap structure" or "terminal cap moiety" means chemical modifications, which have been incorporated at either terminus of an antisense compound.

"cEt" or "constrained ethyl" means a bicyclic nucleoside having a sugar moiety comprising a bridge connecting the 4'-carbon and the 2'-carbon, wherein the bridge has the formula: 4'-CH(CH$_3$)—O-2'.

"Constrained ethyl nucleoside" (also cEt nucleoside) means a nucleoside comprising a bicyclic sugar moiety comprising a 4'-CH(CH$_3$)—O-2' bridge.

"Chemically distinct region" refers to a region of an antisense compound that is in some way chemically different than another region of the same antisense compound. For example, a region having 2'-O-methoxyethyl nucleotides is chemically distinct from a region having nucleotides without 2'-O-methoxyethyl modifications.

"Chimeric antisense compound" means an antisense compound that has at least two chemically distinct regions.

"Co-administration" means administration of two or more pharmaceutical agents to an individual.

The two or more pharmaceutical agents may be in a single pharmaceutical composition, or may be in separate pharmaceutical compositions. Each of the two or more pharmaceutical agents may be administered through the same or different routes of administration. Co-administration encompasses parallel or sequential administration.

"Complementarity" means the capacity for pairing between nucleobases of a first nucleic acid and a second nucleic acid.

"Contiguous nucleobases" means nucleobases immediately adjacent to each other.

"Diluent" means an ingredient in a composition that lacks pharmacological activity, but is pharmaceutically necessary or desirable. For example, the diluent in an injected composition may be a liquid, e.g. saline solution.

"Dose" means a specified quantity of a pharmaceutical agent provided in a single administration, or in a specified time period. In certain embodiments, a dose may be administered in one, two, or more boluses, tablets, or injections. For example, in certain embodiments where subcutaneous administration is desired, the desired dose requires a volume not easily accommodated by a single injection, therefore, two or more injections may be used to achieve the desired dose. In certain embodiments, the pharmaceutical agent is administered by infusion over an extended period of time or continuously. Doses may be stated as the amount of pharmaceutical agent per hour, day, week, or month.

"Effective amount" means the amount of active pharmaceutical agent sufficient to effectuate a desired physiological outcome in an individual in need of the agent. The effective amount may vary among individuals depending on the health and physical condition of the individual to be treated, the taxonomic group of the individuals to be treated, the formulation of the composition, assessment of the individual's medical condition, and other relevant factors.

"Fully complementary" or "100% complementary" means each nucleobase of a first nucleic acid has a complementary nucleobase in a second nucleic acid. In certain embodiments, a first nucleic acid is an antisense compound and a target nucleic acid is a second nucleic acid.

"Gapmer" means a chimeric antisense compound in which an internal region having a plurality of nucleosides that support RNase H cleavage is positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"Gap-widened" means a chimeric antisense compound having a gap segment of 12 or more contiguous 2'-deoxyribonucleosides positioned between and immediately adjacent to 5' and 3' wing segments having from one to six nucleosides.

"Hybridization" means the annealing of complementary nucleic acid molecules. In certain embodiments, complementary nucleic acid molecules include an antisense compound and a target nucleic acid.

"Hyperproliferative disease" means a disease characterized by rapid or excessive growth and reproduction of cells. Examples of hyperproliferative diseases include cancer, e.g., carcinomas, sarcomas, lymphomas, and leukemias as well as associated malignancies and metastases.

"Identifying an animal at risk for hyperproliferative disease" means identifying an animal having been diagnosed with a hyperproliferative disease or identifying an animal predisposed to develop a hyperproliferative disease. Individuals predisposed to develop a hyperproliferative disease include those having one or more risk factors for hyperproliferative disease including older age; history of other hyperproliferative diseases; history of tobacco use; history of exposure to sunlight and/or ionizing radiation; prior contact with certain chemicals, especially continuous contact; past or current infection with certain viruses and bacteria; prior or current use of certain hormone therapies; genetic predisposition; alcohol use; and certain lifestyle choices including poor diet, lack of physical activity, and/or being overweight. Such identification may be accomplished by any method including evaluating an individual's medical history and standard clinical tests or assessments.

"Immediately adjacent" means there are no intervening elements between the immediately adjacent elements.

"Inhibiting STAT3" means reducing expression of STAT3 mRNA and/or protein levels in the presence of a STAT3 antisense compound, including a STAT3 antisense oligonucleotide, as compared to expression of STAT3 mRNA and/or protein levels in the absence of a STAT3 antisense compound, such as an antisense oligonucleotide.

"Individual" means a human or non-human animal selected for treatment or therapy.

"Internucleoside linkage" refers to the chemical bond between nucleosides.

"Linked nucleosides" means adjacent nucleosides which are bonded together.

"Mismatch" or "non-complementary nucleobase" refers to the case when a nucleobase of a first nucleic acid is not capable of pairing with the corresponding nucleobase of a second or target nucleic acid.

"Modified internucleoside linkage" refers to a substitution or any change from a naturally occurring internucleoside bond (i.e. a phosphodiester internucleoside bond).

"Modified nucleobase" refers to any nucleobase other than adenine, cytosine, guanine, thymidine, or uracil. An "unmodified nucleobase" means the purine bases adenine (A) and guanine (G), and the pyrimidine bases thymine (T), cytosine (C), and uracil (U).

"Modified nucleotide" means a nucleotide having, independently, a modified sugar moiety, modified internucleoside linkage, or modified nucleobase. A "modified nucleoside" means a nucleoside having, independently, a modified sugar moiety or modified nucleobase.

"Modified oligonucleotide" means an oligonucleotide comprising a modified internucleoside linkage, a modified sugar, and/or a modified nucleobase.

"Modified sugar" refers to a substitution or change from a natural sugar.

"Motif" means the pattern of chemically distinct regions in an antisense compound.

"Naturally occurring internucleoside linkage" means a 3' to 5' phosphodiester linkage.

"Natural sugar moiety" means a sugar found in DNA (2'-H) or RNA (2'-OH).

"Nucleic acid" refers to molecules composed of monomeric nucleotides. A nucleic acid includes ribonucleic acids (RNA), deoxyribonucleic acids (DNA), single-stranded nucleic acids, double-stranded nucleic acids, small interfering ribonucleic acids (siRNA), and microRNAs (miRNA).

"Nucleobase" means a heterocyclic moiety capable of pairing with a base of another nucleic acid.

"Nucleobase sequence" means the order of contiguous nucleobases independent of any sugar, linkage, or nucleobase modification.

"Nucleoside" means a nucleobase linked to a sugar.

"Nucleoside mimetic" includes those structures used to replace the sugar or the sugar and the base and not necessarily the linkage at one or more positions of an oligomeric compound such as for example nucleoside mimetics having morpholino, cyclohexenyl, cyclohexyl, tetrahydropyranyl, bicyclo or tricyclo sugar mimetics, e.g., non furanose sugar units. Nucleotide mimetic includes those structures used to replace the nucleoside and the linkage at one or more positions of an oligomeric compound such as for example peptide nucleic acids or morpholinos (morpholinos linked by —N(H)—C(=O)—O— or other non-phosphodiester linkage). Sugar surrogate overlaps with the slightly broader term nucleoside mimetic but is intended to indicate replacement of the sugar unit (furanose ring) only. The tetrahydropyranyl rings provided herein are illustrative of an example of a sugar surrogate wherein the furanose sugar group has been replaced with a tetrahydropyranyl ring system.

"Nucleotide" means a nucleoside having a phosphate group covalently linked to the sugar portion of the nucleoside.

"Off-target effect" refers to an unwanted or deleterious biological effect associated with modulation of RNA or protein expression of a gene other than the intended target nucleic acid.

"Oligomeric compound" or "oligomer" means a polymer of linked monomeric subunits which is capable of hybridizing to at least a region of a nucleic acid molecule.

"Oligonucleotide" means a polymer of linked nucleosides each of which can be modified or unmodified, independent one from another.

"Parenteral administration" means administration through injection (e.g., bolus injection) or infusion. Parenteral administration includes subcutaneous administration, intravenous administration, intramuscular administration, intraarterial administration, intraperitoneal administration, or intracranial administration, e.g., intrathecal or intracerebroventricular administration.

"Peptide" means a molecule formed by linking at least two amino acids by amide bonds. Peptide refers to polypeptides and proteins.

"Pharmaceutical composition" means a mixture of substances suitable for administering to an individual. For example, a pharmaceutical composition may comprise one or more active pharmaceutical agents and a sterile aqueous solution. In certain embodiments, a pharmaceutical composition shows activity in free uptake assay in certain cell lines.

"Pharmaceutically acceptable derivative" encompasses pharmaceutically acceptable salts, conjugates, prodrugs or isomers of the compounds described herein.

"Pharmaceutically acceptable salts" means physiologically and pharmaceutically acceptable salts of antisense compounds, i.e., salts that retain the desired biological activity of the parent oligonucleotide and do not impart undesired toxicological effects thereto.

"Phosphorothioate linkage" means a linkage between nucleosides where the phosphodiester bond is modified by replacing one of the non-bridging oxygen atoms with a sulfur atom. A phosphorothioate linkage (P=S) is a modified internucleoside linkage.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an antisense compound.

"Prevent" refers to delaying or forestalling the onset or development of a disease, disorder, or condition for a period of time from minutes to indefinitely. Prevent also means reducing risk of developing a disease, disorder, or condition.

"Prodrug" means a therapeutic agent that is prepared in an inactive form that is converted to an active form within the body or cells thereof by the action of endogenous enzymes or other chemicals or conditions.

"Side effects" means physiological responses attributable to a treatment other than the desired effects.

In certain embodiments, side effects include injection site reactions, liver function test abnormalities, renal function abnormalities, liver toxicity, renal toxicity, central nervous system abnormalities, myopathies, and malaise. For example, increased aminotransferase levels in serum may indicate liver toxicity or liver function abnormality. For example, increased bilirubin may indicate liver toxicity or liver function abnormality.

"Signal Transducer and Activator of Transcription 3 nucleic acid" or "STAT3 nucleic acid" means any nucleic acid encoding STAT3. For example, in certain embodiments, a STAT3 nucleic acid includes a DNA sequence encoding STAT3, an RNA sequence transcribed from DNA encoding STAT3 (including genomic DNA comprising introns and exons), and an mRNA sequence encoding STAT3. "STAT3 mRNA" means an mRNA encoding a STAT3 protein.

"Single-stranded oligonucleotide" means an oligonucleotide which is not hybridized to a complementary strand.

"Specifically hybridizable" refers to an antisense compound having a sufficient degree of complementarity between an antisense oligonucleotide and a target nucleic acid to induce a desired effect, while exhibiting minimal or no effects on non-target nucleic acids under conditions in which specific binding is desired, i.e., under physiological conditions in the case of in vivo assays and therapeutic treatments.

"Targeting" or "targeted" means the process of design and selection of an antisense compound that will specifically hybridize to a target nucleic acid and induce a desired effect.

"Target nucleic acid," "target RNA," "target mRNA," and "target RNA transcript" all refer to a nucleic acid capable of being targeted by antisense compounds.

"Target segment" means the sequence of nucleotides of a target nucleic acid to which an antisense compound is targeted. "5' target site" refers to the 5'-most nucleotide of a target segment. "3' target site" refers to the 3'-most nucleotide of a target segment.

"Therapeutically effective amount" means an amount of a pharmaceutical agent that provides a therapeutic benefit to an individual.

"Treat" refers to administering a pharmaceutical composition to effect an alteration or improvement of a disease, disorder, or condition.

"Unmodified nucleotide" means a nucleotide composed of naturally occurring nucleobases, sugar moieties, and internucleoside linkages. In certain embodiments, an unmodified nucleotide is an RNA nucleotide (i.e. β-D-ribonucleosides) or a DNA nucleotide (i.e. β-D-deoxyribonucleoside).

Certain Embodiments

In certain embodiments provided are methods, compounds, and compositions for inhibiting STAT3 mRNA or protein expression.

In certain embodiments provided are methods for preventing tumor growth and tumor volume. In certain embodiments provided are methods for reducing tumor growth and tumor volume.

In certain embodiments provided are methods, compounds, and compositions for the treatment, prevention, or amelioration of diseases, disorders, and conditions associated with STAT3 in an individual in need thereof. Also contemplated are methods and compounds for the preparation of a medicament for the treatment, prevention, or amelioration of a disease, disorder, or condition associated with STAT3. STAT3 associated diseases, disorders, and conditions include hyperproliferative diseases, e.g., cancer, carcinomas, sarcomas, lymphomas, and leukemias as well as associated malignancies and metastases.

In certain embodiments provided are STAT3 antisense compounds for use in treating, preventing, or ameliorating a STAT3 associated disease. In certain embodiments, STAT3 antisense compounds are STAT3 antisense oligonucleotides, which are capable of inhibiting the expression of STAT3 mRNA and/or STAT3 protein in a cell, tissue, or animal.

In certain embodiments provided are a STAT3 antisense compound as described herein for use in treating or preventing lung cancer, including non small cell lung cancer (NSCLC), pancreatic cancer, colorectal cancer, multiple myeloma, hepatocellular carcinoma (HCC), glioblastoma, ovarian cancer, osteosarcoma, head and neck cancer, breast cancer, epidermoid carcinomas, intestinal adenomas, prostate cancer, and gastric cancer.

In certain embodiments provided are a STAT3 antisense compound as described herein for use in treating or preventing cancer from metastasizing.

In certain embodiments provided are a STAT3 antisense compound, as described herein, for use in treating, preventing, or ameliorating hyperproliferative diseases, e.g., cancer, carcinomas, sarcomas, lymphomas, and leukemias as well as associated malignancies and metastases.

In certain embodiments provided are antisense compounds targeted to a STAT3 nucleic acid. In certain embodiments, the STAT3 nucleic acid is any of the sequences set forth in GENBANK Accession No. NM_139276.2 (incorporated herein as SEQ ID NO: 1) or the complement of GENBANK Accession No. NT_010755.14 truncated from nucleotides 4185000 to 4264000 (incorporated herein as SEQ ID NO: 2).

In certain embodiments, the antisense compounds provided herein are targeted to any one of the following regions of SEQ ID NO 1: 250-286; 250-285; 264-285; 264-282; 728-745; 729-745; 729-744; 787-803; 867-883; 955-978; 1146-1170; 1896-1920; 1899-1920; 1899-1919; 1899-1918; 1899-1916; 1901-1916; 1946-1963; 1947-1963; 2155-2205; 2155-2187; 2156-2179; 2204-2221; 2681-2696; 2699-2716; 3001-3033; 3008-3033; 3010-3033; 3010-3032, 3015-3033, 3015-3032, 3015-3031, 3016-3033, 3016-3032, 3016-3033; 3452-3499; 3460-3476; 3583-3608; 3591-3616; 3595-3615; 3595-3614; 3595-3612; 3675-3706; 3713-3790; 3715-3735; 3833-3878; 3889-3932; 3977-4012; 4067-4100; 4225-4256; 4234-4252; 4235-4252; 4235-4251; 4236-4252; 4306-4341; 4431-4456; 4439-4454; 4471-4510; 4488-4505; 4530-4558; 4539-4572; 4541-4558; 4636-4801; 4782-4796; 4800-4823; 4811-4847; 4813-4859; 4813-4815; 4813-4831; 4827-4859; 4827-4844; 4842-4859.

In certain embodiments, the antisense compounds provided herein are complementary within any one of the following regions of SEQ ID NO 1: 250-286; 250-285; 264-285; 264-282; 728-745; 729-745; 729-744; 787-803; 867-883; 955-978; 1146-1170; 1896-1920; 1899-1920; 1899-1919; 1899-1918; 1899-1916; 1901-1916; 1946-1963; 1947-1963; 2155-2205; 2155-2187; 2156-2179; 2204-2221; 2681-2696; 2699-2716; 3001-3033; 3008-3033; 3010-3033, 3010-3032, 3015-3033, 3015-3032, 3015-3031, 3016-3033, 3016-3032, 3016-3033; 3452-3499; 3460-3476; 3583-3608; 3591-3616; 3595-3615; 3595-3614; 3595-3612; 3675-3706; 3713-3790; 3715-3735; 3833-3878; 3889-3932; 3977-4012; 4067-4100; 4225-4256; 4234-4252; 4235-4252; 4235-4251; 4236-4252; 4306-4341; 4431-4456; 4439-4454; 4471-4510; 4488-4505; 4530-4558; 4539-4572; 4541-4558; 4636-4801; 4782-4796; 4800-4823; 4811-4847; 4813-4859; 4813-4815; 4813-4831; 4827-4859; 4827-4844; 4842-4859. In certain embodiments, provided are compounds comprising:

a modified antisense oligonucleotide consisting of 12 to 22 linked nucleosides, wherein the modified antisense oligonucleotide comprises:
a 5'-wing consisting of 1 to 5 linked nucleosides;
a 3'-wing consisting of 1 to 5 linked nucleosides;
a gap between the 5'-wing and the 3'-wing consisting of 8 to 12 linked 2'-deoxynucleosides; and
wherein at least one of the 5'-wing and the 3'-wing comprises at least one bicyclic nucleoside or 2'-substituted nucleoside;
wherein the nucleobase sequence of the modified antisense oligonucleotide is complementary to an equal length portion of any of nucleobases 250-286; 250-285; 264-285; 264-282; 728-745; 729-745; 729-744; 787-803; 867-883; 955-978; 1146-1170; 1896-1920; 1899-1920; 1899-1919; 1899-1918; 1899-1916; 1901-1916; 1946-1963; 1947-1963; 2155-2205; 2155-2187; 2156-2179; 2204-2221; 2681-2696; 2699-2716; 3001-3033; 3008-3033; 3010-3033, 3010-3032, 3015-3033, 3015-3032, 3015-3031, 3016-3033, 3016-3032, 3016-3033; 3452-3499; 3460-3476; 3583-3608; 3591-3616; 3595-3615; 3595-3614; 3595-3612; 3675-3706; 3713-3790; 3715-3735; 3833-3878; 3889-3932; 3977-4012; 4067-4100; 4225-4256; 4234-4252; 4235-4252; 4235-4251; 4236-4252; 4306-4341; 4431-4456; 4439-4454; 4471-4510; 4488-4505; 4530-4558; 4539-4572; 4541-4558; 4636-4801; 4782-4796; 4800-4823; 4811-4847; 4813-4859; 4813-4815; 4813-4831; 4827-4859; 4827-4844; 4842-4859 of the nucleobase sequence of SEQ ID NO: 1.

In certain embodiments, the antisense compounds provided herein are targeted to any one of the following regions of SEQ ID NO 2: 2668-2688; 2703-2720; 5000-5021; 5001-5017; 5697-5722; 5699-5716; 6475-6490; 6475-6491; 6476-6491; 7682-7705; 8078-8097; 8079-8095; 9862-9811; 9870-9897; 9875-9893; 9875-9891; 9877-9893; 11699-11719; 12342-12366; 12345-12364; 12346-12364; 12347-12364; 12353-12380; 12357-12376; 12358-12376; 12358-12373; 12360-12376; 14128-14148; 16863-16883; 46091-46111; 50692-50709; 50693-50709; 50693-50708; 61325-61349; 66133-66157; 66136-66157; 66136-66155; 66136-66153; 66138-66153; 66184-66200; 67067-67083; 4171-74220; 74199-74220; 74202-74220; 74171-74219; 74199-74219; 74202-74219; 74171-74218; 74199-74218; 74202-74218; 74723-74768; 74764-74803; 74782-74802; 74782-74801; 74782-74800; 74782-74799; 74783-74802; 74783-74801; 74783-74800; 74783-74799; 74862-74893; 74900-74977;

74902-74922; 74902-74920; 75070-75119; 75164-75199; 75254-75287; 75412-75443; 75421-75439; 75422-75439; 75422-75438; 75423-75439; 75423-75438; 75493-75528; 75616-75643; 75626-75641; 75658-75699; 75676-75692; 75717-75745; 75726-75759; 75726-75745; 75727-75745; 75728-75745; 75831-75988; 75852-75969; 75969-75984; 75987-76056; 76000-76046; 76000-76032; 76000-76018; 76014-76046; 76014-76032; 76029-76046; and 76031-76046.

In certain embodiments, the antisense compounds provided herein are complementary within any one of the following regions of SEQ ID NO 2: 2668-2688; 2703-2720; 5000-5021; 5001-5017; 5697-5722; 5699-5716; 6475-6490; 6475-6491; 6476-6491; 7682-7705; 8078-8097; 8079-8095; 9862-9811; 9870-9897; 9875-9893; 9875-9891; 9877-9893; 11699-11719; 12342-12366; 12345-12364; 12346-12364; 12347-12364; 12353-12380; 12357-12376; 12358-12376; 12358-12373; 12360-12376; 14128-14148; 16863-16883; 46091-46111; 50692-50709; 50693-50709; 50693-50708; 61325-61349; 66133-66157; 66136-66157; 66136-66155; 66136-66153; 66138-66153; 66184-66200; 67067-67083; 4171-74220; 74199-74220; 74202-74220; 74171-74219; 74199-74219; 74202-74219; 74171-74218; 74199-74218; 74202-74218; 74723-74768; 74764-74803; 74782-74802; 74782-74801; 74782-74800; 74782-74799; 74783-74802; 74783-74801; 74783-74800; 74783-74799; 74862-74893; 74900-74977; 74902-74922; 74902-74920; 75070-75119; 75164-75199; 75254-75287; 75412-75443; 75421-75439; 75422-75439; 75422-75438; 75423-75439; 75423-75438; 75493-75528; 75616-75643; 75626-75641; 75658-75699; 75676-75692; 75717-75745; 75726-75759; 75726-75745; 75727-75745; 75728-75745; 75831-75988; 75852-75969; 75969-75984; 75987-76056; 76000-76046; 76000-76032; 76000-76018; 76014-76046; 76014-76032; 76029-76046; and 76031-76046.

In certain embodiments, provided are compounds comprising:
a modified antisense oligonucleotide consisting of 12 to 22 linked nucleosides, wherein the modified antisense oligonucleotide comprises:
a 5'-wing consisting of 1 to 5 linked nucleosides;
a 3'-wing consisting of 1 to 5 linked nucleosides;
a gap between the 5'-wing and the 3'-wing consisting of 8 to 12 linked 2'-deoxynucleosides; and
wherein at least one of the 5'-wing and the 3'-wing comprises at least one bicyclic nucleoside or 2'-substituted nucleoside;
wherein the nucleobase sequence of the modified antisense oligonucleotide is complementary to an equal length portion of any of nucleobases 2668-2688; 2703-2720; 5000-5021; 5001-5017; 5697-5722; 5699-5716; 6475-6490; 6475-6491; 6476-6491; 7682-7705; 8078-8097; 8079-8095; 9862-9811; 9870-9897; 9875-9893; 9875-9891; 9877-9893; 11699-11719; 12342-12366; 12345-12364; 12346-12364; 12347-12364; 12353-12380; 12357-12376; 12358-12376; 12358-12373; 12360-12376; 14128-14148; 16863-16883; 46091-46111; 50692-50709; 50693-50709; 50693-50708; 61325-61349; 66133-66157; 66136-66157; 66136-66155; 66136-66153; 66138-66153; 66184-66200; 67067-67083; 4171-74220; 74199-74220; 74202-74220; 74171-74219; 74199-74219; 74202-74219; 74171-74218; 74199-74218; 74202-74218; 74723-74768; 74764-74803; 74782-74802; 74782-74801; 74782-74800; 74782-74799; 74783-74802; 74783-74801; 74783-74800; 74783-74799; 74862-74893; 74900-74977; 74902-74922; 74902-74920; 75070-75119; 75164-75199; 75254-75287; 75412-75443; 75421-75439; 75422-75439; 75422-75438; 75423-75439; 75423-75438; 75493-75528; 75616-75643; 75626-75641; 75658-75699; 75676-75692; 75717-75745; 75726-75759; 75726-75745; 75727-75745; 75728-75745; 75831-75988; 75852-75969; 75987-76056; 75969-75984; 75987-76056; 76000-76046; 76000-76032; 76000-76018; 76014-76046; 76014-76032; 76029-76046; and 76031-76046 of the nucleobase sequence of SEQ ID NO: 2.

Certain embodiments provide compounds comprising a modified oligonucleotide consisting of 12 to 30 linked nucleosides having a nucleobase sequence comprising a portion of at least 12 contiguous nucleobases complementary to an equal length portion of nucleobases 3008 to 3033 of SEQ ID NO: 1, wherein the nucleobase sequence is complementary to SEQ ID NO: 1.

Certain embodiments provide compounds comprising a modified oligonucleotide consisting of 12 to 30 linked nucleosides having a nucleobase sequence comprising a portion of at least 12 contiguous nucleobases complementary to an equal length portion of nucleobases 3016 to 3031 of SEQ ID NO: 1, wherein the nucleobase sequence is complementary to SEQ ID NO: 1.

Certain embodiments provide compounds comprising a modified oligonucleotide consisting of 12 to 30 linked nucleosides having a nucleobase sequence comprising a portion of at least 12 contiguous nucleobases complementary to an equal length portion of nucleobases 6476 to 6491 of SEQ ID NO: 2, wherein the nucleobase sequence is complementary to SEQ ID NO: 2.

Certain embodiments provide compounds comprising a modified oligonucleotide consisting of 12 to 30 linked nucleosides having a nucleobase sequence comprising a portion of at least 12 contiguous nucleobases complementary to an equal length portion of nucleobases 250-286; 250-285; 264-285; 264-282; 728-745; 729-745; 729-744; 787-803; 867-883; 955-978; 1146-1170; 1896-1920; 1899-1920; 1899-1919; 1899-1918; 1899-1916; 1901-1916; 1946-1963; 1947-1963; 2155-2205; 2155-2187; 2156-2179; 2204-2221; 2681-2696; 2699-2716; 3001-3033; 3008-3033; 3010-3033, 3010-3032, 3015-3033, 3015-3032, 3015-3031, 3016-3033, 3016-3032, 3016-3033; 3452-3499; 3460-3476; 3583-3608; 3591-3616; 3595-3615; 3595-3614; 3595-3612; 3675-3706; 3713-3790; 3715-3735; 3833-3878; 3889-3932; 3977-4012; 4067-4100; 4225-4256; 4234-4252; 4235-4252; 4235-4251; 4236-4252; 4306-4341; 4431-4456; 4439-4454; 4471-4510; 4488-4505; 4530-4558; 4539-4572; 4541-4558; 4636-4801; 4782-4796; 4800-4823; 4811-4847; 4813-4859; 4813-4815; 4813-4831; 4827-4859; 4827-4844; or 4842-4859 of SEQ ID NO: 1, wherein the nucleobase sequence of the modified oligonucleotide is complementary to SEQ ID NO: 1.

Certain embodiments provide compounds comprising a modified oligonucleotide consisting of 12 to 30 linked nucleosides having a nucleobase sequence comprising a portion of at least 12 contiguous nucleobases complementary to an equal length portion of nucleobases 2668-2688; 2703-2720; 5000-5021; 5001-5017; 5697-5722; 5699-5716; 6475-6490; 6475-6491; 6476-6491; 7682-7705; 8078-8097; 8079-8095; 9862-9811; 9870-9897; 9875-9893; 9875-9891; 9877-9893; 11699-11719; 12342-12366; 12345-12364; 12346-12364; 12347-12364; 12353-12380; 12357-12376; 12358-12376; 12358-12373; 12360-12376; 14128-14148; 16863-16883; 46091-46111; 50692-50709; 50693-50709; 50693-50708; 61325-61349; 66133-66157; 66136-66157; 66136-66155; 66136-66153; 66138-66153; 66184-66200; 67067-67083; 4171-74220; 74199-74220; 74202-74220; 74171-74219; 74199-74219; 74202-74219; 74171-74218; 74199-74218; 74202-74218; 74723-74768; 74764-74803; 74782-74802; 74782-74801; 74782-74800; 74782-74799; 74783-

74802; 74783-74801; 74783-74800; 74783-74799; 74862-74893; 74900-74977; 74902-74922; 74902-74920; 75070-75119; 75164-75199; 75254-75287; 75412-75443; 75421-75439; 75422-75439; 75422-75438; 75423-75439; 75423-75438; 75493-75528; 75616-75643; 75626-75641; 75658-75699; 75676-75692; 75717-75745; 75726-75759; 75726-75745; 75727-75745; 75728-75745; 75831-75988; 75852-75969; 75969-75984; 75987-76056; 76000-76046; 76000-76032; 76000-76018; 76014-76046; 76014-76032; 76029-76046; or 76031-76046 of SEQ ID NO: 2, wherein the nucleobase sequence of the modified oligonucleotide is complementary to SEQ ID NO: 2.

In certain embodiments, the nucleobase sequence of the modified oligonucleotide comprises the sequence of SEQ ID NO: 245.

In certain embodiments, the nucleobase sequence of the modified oligonucleotide consists of the sequence of SEQ ID NO: 245.

In certain embodiments, the nucleobase sequence of the modified oligonucleotide comprises the sequence of SEQ ID NO: 413.

In certain embodiments, the nucleobase sequence of the modified oligonucleotide consists of the sequence of SEQ ID NO: 413.

In certain embodiments, the modified oligonucleotide is 100% complementary to SEQ ID NO: 1 or 2.

In certain embodiments, the modified oligonucleotide consists of a single-stranded modified oligonucleotide.

In certain embodiments, the modified oligonucleotide has at least one modified internucleoside linkage.

In certain embodiments, each internucleoside linkage is a phosphorothioate internucleoside linkage.

In certain embodiments, at least one nucleoside comprises a modified sugar.

In certain embodiments, at least one modified sugar is a bicyclic sugar.

In certain embodiments, the bicyclic sugar comprises a 4'-CH$_2$—O-2' bridge.

In certain embodiments, the bicyclic sugar comprises a 4'-CH(CH$_3$)—O-2' bridge.

In certain embodiments, the modified sugar comprises a 2'-O(CH$_2$)$_2$—OCH$_3$ group.

In certain embodiments, the modified sugar comprises a 2'-O—CH$_3$ group.

In certain embodiments, at least one nucleoside of the modified oligonucleotide comprises a modified nucleobase.

In certain embodiments, the modified nucleobase is a 5'-methylcytosine.

In certain embodiments, the modified oligonucleotide comprises:
a 5'-wing consisting of 1 to 5 linked nucleosides;
a 3'-wing consisting of 1 to 5 linked nucleosides;
a gap between the 5'-wing and the 3'-wing consisting of 8 to 12 linked 2'-deoxynucleosides; and
wherein at least one of the 5'-wing and the 3'-wing comprises at least one bicyclic nucleoside or one 2'-substituted nucleoside.

In certain embodiments, the modified oligonucleotide comprises:
a 5'-wing consisting of 1 to 5 linked nucleosides;
a 3'-wing consisting of 1 to 5 linked nucleosides;
a gap between the 5'-wing and the 3'-wing consisting of 8 to 12 linked 2'-deoxynucleosides; and
wherein at least one of the 5'-wing and the 3'-wing comprises at least one bicyclic nucleoside and at least one 2'-substituted nucleoside.

In certain embodiments, the 2'-substituted nucleoside comprises any of the group consisting of a 2% O(CH$_2$)$_2$—OCH$_3$ group or a 2'-O—CH$_3$ group.

In certain embodiments, the bicyclic nucleoside comprises any of the group consisting of a 4'-CH$_2$—O-2' bridge and a 4'-CH(CH$_3$)—O-2' bridge.

In certain embodiments, the modified oligonucleotide comprises:
a 5'-wing consisting of 3 linked nucleosides;
a 3'-wing consisting of 3 linked nucleosides;
a gap between the 5'-wing and the 3'-wing consisting of 10 linked 2'-deoxynucleosides;
wherein each nucleoside of each of the 5'-wing and the 3'-wing comprises a constrained ethyl nucleoside;
wherein each internucleoside linkage is a phosphorothioate linkage; and
wherein each cytosine is a 5'-methylcytosine.

Certain embodiments provide compounds, comprising a modified oligonucleotide consisting of 12 to 30 linked nucleosides and having a nucleobase sequence comprising at least 12 contiguous nucleobases of the nucleobase sequence of SEQ ID NO: 245.

Certain embodiments provide compounds, comprising a modified oligonucleotide consisting of 12 to 30 linked nucleosides and having a nucleobase sequence comprising at least 12 contiguous nucleobases of the nucleobase sequence of SEQ ID NO: 413.

Certain embodiment provide compounds, comprising a modified oligonucleotide consisting of 12 to 30 linked nucleosides and having a nucleobase sequence comprising at least 12 contiguous nucleobases of any of the nucleobase sequences of SEQ ID NOs: 9-426, 430-442, 445-464, 471-498, 500-1034, 1036-1512, and 1541-2757.

In certain embodiments, the modified oligonucleotide consists of a single-stranded modified oligonucleotide.

In certain embodiments, at least one internucleoside linkage of the modified oligonucleotide is a modified internucleoside linkage.

In certain embodiments, each internucleoside linkage is a phosphorothioate internucleoside linkage.

In certain embodiments, at least one nucleoside comprises a modified sugar.

In certain embodiments, at least one modified sugar is a bicyclic sugar.

In certain embodiments, the bicyclic sugar comprises a 4'-CH$_2$—O-2' bridge.

In certain embodiments, the bicyclic sugar comprises a 4'-CH(CH$_3$)—O-2' bridge.

In certain embodiments, the modified sugar comprises a 2'—O(CH$_2$)$_2$—OCH$_3$ group.

In certain embodiments, the modified sugar comprises a 2'-O—CH$_3$ group.

In certain embodiments, at least one nucleoside of the modified oligonucleotide comprises a modified nucleobase.

In certain embodiments, the modified nucleobase is a 5'-methylcytosine.

In certain embodiments, the modified oligonucleotide comprises: a 5'-wing consisting of 1 to 5 linked nucleosides;
a 3'-wing consisting of 1 to 5 linked nucleosides;
a gap between the 5'-wing and the 3'-wing consisting of 8 to 12 linked 2'-deoxynucleosides; and
wherein at least one of the 5'-wing and the 3'-wing comprises at least one bicyclic nucleoside or 2'-substituted nucleoside.

In certain embodiments, the modified oligonucleotide comprises:
a 5'-wing consisting of 1 to 5 linked nucleosides;
a 3'-wing consisting of 1 to 5 linked nucleosides;
a gap between the 5'-wing and the 3'-wing consisting of 8 to 12 linked 2'-deoxynucleosides; and
wherein at least one of the 5'-wing and the 3'-wing comprises at least one bicyclic nucleoside and at least one 2'-substituted nucleoside.

In certain embodiments, the 2'-substituted nucleoside comprises any of the group consisting of a 2'% O(CH$_2$)$_2$—OCH$_3$ group or a 2'-O—CH$_3$ group.

In certain embodiments, the bicyclic nucleoside comprises any of the group consisting of a 4'-CH$_2$—O-2' bridge and a 4'-CH(CH$_3$)—O-2' bridge.

In certain embodiments, the modified oligonucleotide comprises:
a 5'-wing consisting of 3 linked nucleosides;
a 3'-wing consisting of 3 linked nucleosides;
a gap between the 5'-wing and the 3'-wing consisting of 10 linked 2'-deoxynucleosides;
wherein each nucleoside of each of the 5'-wing and the 3'-wing comprises a constrained ethyl nucleoside;
wherein each internucleoside linkage is a phosphorothioate linkage; and
wherein each cytosine is a 5'-methylcytosine.

Certain embodiments provide compounds comprising:
a modified oligonucleotide consisting of 12 to 22 linked nucleosides, wherein the modified oligonucleotide comprises:
a 5'-wing consisting of 1 to 5 linked nucleosides;
a 3'-wing consisting of 1 to 5 linked nucleosides;
a gap between the 5'-wing and the 3'-wing consisting of 8 to 12 linked 2'-deoxynucleosides;
wherein at least one of the 5'-wing and the 3'-wing comprises at least one bicyclic nucleoside or a 2'-substituted nucleoside;
wherein the nucleobase sequence of the modified oligonucleotide is complementary to an equal length portion of nucleobases 3016 to 3031 of the nucleobase sequence of SEQ ID NO: 1; and
wherein the compound inhibits expression of STAT3 mRNA expression.

Certain embodiments provide compounds comprising:
a modified oligonucleotide consisting of 12 to 22 linked nucleosides, wherein the modified oligonucleotide comprises:
a 5'-wing consisting of 1 to 5 linked nucleosides;
a 3'-wing consisting of 1 to 5 linked nucleosides;
a gap between the 5'-wing and the 3'-wing consisting of 8 to 12 linked 2'-deoxynucleosides;
wherein at least one of the 5'-wing and the 3'-wing comprises at least one bicyclic nucleoside or a 2'-substituted nucleoside;
wherein the nucleobase sequence of the modified oligonucleotide is complementary to an equal length portion of nucleobases 6476 to 6491 of the nucleobase sequence of SEQ ID NO: 2; and
wherein the compound inhibits expression of STAT3 mRNA expression.

In certain embodiments, at least one of the 5'-wing and the 3'-wing comprises at least one 2'-deoxynucleoside.

In certain embodiments, the modified oligonucleotide consists of a single-stranded modified oligonucleotide.

In certain embodiments, the modified oligonucleotide comprises at least one bicyclic nucleoside.

In certain embodiments, at least one bicyclic nucleoside comprises a 4'-CH(CH$_3$)—O-2' bridge.

In certain embodiments, each bicyclic nucleoside comprises a 4'-CH(CH$_3$)—O-2' bridge.

In certain embodiments, at least one bicyclic nucleoside comprises a 4'-CH$_2$—O-2' bridge.

In certain embodiments, each bicyclic nucleoside comprises a 4'-CH$_2$—O-2' bridge.

In certain embodiments, the modified oligonucleotide comprises at least one 2'-substituted nucleoside.

In certain embodiments, at least one 2'-substituted nucleoside comprises a 2'-O(CH$_2$)$_2$—OCH$_3$ group.

In certain embodiments, each 2'-substituted nucleoside comprises a 2'-O(CH$_2$)$_2$—OCH$_3$ group.

In certain embodiments, at least one 2'-substituted nucleoside comprises a 2'-O—CH$_3$ group.

In certain embodiments, each 2'-substituted nucleoside comprises a 2'-O—CH$_3$ group.

In certain embodiments, at least one internucleoside linkage is a modified internucleoside linkage.

In certain embodiments, each modified internucleoside linkage is a phosphorothioate linkage.

In certain embodiments, at least one nucleoside of the modified oligonucleotide comprises a modified nucleobase.

In certain embodiments, the modified nucleobase is a 5'-methylcytosine.

In certain embodiments, the modified oligonucleotide has a sugar motif described by Formula A as follows:

wherein:
each A is independently a 2'-substituted nucleoside;
each B is independently a bicyclic nucleoside;
each J is independently either a 2'-substituted nucleoside or a 2'-deoxynucleoside;
each D is a 2'-deoxynucleoside;
m is 0-4; n is 0-2; p is 0-2; r is 0-2; t is 0-2; v is 0-2; w is 0-4; x is 0-2; y is 0-2; z is 0-4; g is 6-14;
provided that:
at least one of m, n, and r is other than 0;
at least one of w and y is other than 0;
the sum of m, n, p, r, and t is from 2 to 5; and
the sum of v, w, x, y, and z is from 2 to 5.

In certain embodiments, the modified oligonucleotide has a sugar motif of any of the group consisting of:
k-d(10)-k
e-d(10)-k
k-d(10)-e
k-k-d(10)-k-k
k-k-d(10)-e-e
e-e-d(10)-k-k
k-k-k-d(10)-k-k-k
e-e-e-d(10)-k-k-k
k-k-k-d(10)-e-e-e
k-k-k-d(10)-k-k-k
e-k-k-d(10)-k-k-e
e-e-k-d(10)-k-k-e
e-d-k-d(10)-k-k-e
e-k-d(10)-k-e-k-e
k-d(10)-k-e-k-e-e
e-e-k-d(10)-k-e-k-e
e-d-d-k-d(9)-k-k-e
e-e-e-e-d(9)-k-k-e
wherein, k is a constrained ethyl nucleoside, e is a 2'-MOE substituted nucleoside, and d is a 2'-deoxynucleoside.

Certain embodiments provide methods of treating a hyperproliferative disease in an animal, comprising administering to an animal in need thereof a compound comprising a modified oligonucleotide consisting of 12 to 30 linked nucleosides and having a nucleobase sequence comprising at least 12 contiguous nucleobases of any of the nucleobase sequences of SEQ ID NOs: 9-426, 430-442, 445-464, 471-498, 500-1034, 1036-1512, and 1541-2757.

Certain embodiments provide methods of treating a hyperproliferative disease in an animal, comprising administering to an animal in need thereof a compound comprising a modified oligonucleotide consisting of 12 to 30 linked nucleosides and having a nucleobase sequence comprising at least 12 contiguous nucleobases of SEQ ID NO: 245.

Certain embodiments provide methods of treating a hyperproliferative disease in an animal, comprising administering to an animal in need thereof a compound comprising a modified oligonucleotide consisting of 12 to 30 linked nucleosides and having a nucleobase sequence comprising at least 12 contiguous nucleobases of SEQ ID NO: 413.

In certain embodiments, the administering reduces tumor size in the animal.

In certain embodiments, the administering reduces tumor volume in the animal.

In certain embodiments, the administering prevents metastasis in the animal.

In certain embodiments, the administering prolongs survival of the animal.

In certain embodiments, the administering reduces cachaxia in the animal.

Certain embodiments provide methods of reducing expression of STAT3 in an animal, comprising administering to an animal in need thereof a compound comprising a modified oligonucleotide consisting of 12 to 30 linked nucleosides and having a nucleobase sequence comprising at least 12 contiguous nucleobases of any of the nucleobase sequences of SEQ ID NOs: 9-426, 430-442, 445-464, 471-498, 500-1034, 1036-1512, and 1541-2757.

Certain embodiments provide methods of reducing expression of STAT3 in an animal, comprising administering to an animal in need thereof a compound comprising a modified oligonucleotide consisting of 12 to 30 linked nucleosides and having a nucleobase sequence comprising at least 12 contiguous nucleobases of SEQ ID NO: 245.

Certain embodiments provide methods of reducing expression of STAT3 in an animal, comprising administering to an animal in need thereof a compound comprising a modified oligonucleotide consisting of 12 to 30 linked nucleosides and having a nucleobase sequence comprising at least 12 contiguous nucleobases of SEQ ID NO: 413.

In certain embodiments, the compound does not have the wing-gap-wing motif of 2-10-2.

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound may be "antisense" to a target nucleic acid, meaning that is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain such embodiments, an antisense oligonucleotide has a nucleobase sequence that, when written in the 5' to 3' direction, comprises the reverse complement of the target segment of a target nucleic acid to which it is targeted.

In certain embodiments, an antisense compound targeted to a STAT3 nucleic acid is 12 to 30 subunits in length. In certain embodiments, an antisense compound targeted to a STAT3 nucleic acid is 14 to 30 subunits in length. In certain embodiments, an antisense compound targeted to a STAT3 nucleic acid is 12 to 22 subunits in length. In other words, such antisense compounds are from 12 to 30 linked subunits, 14 to 30 linked subunits, or 12 to 22 linked subunits, respectively. In other embodiments, the antisense compound is 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the antisense compounds are 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In some embodiments the antisense compound is an antisense oligonucleotide, and the linked subunits are nucleotides.

In certain embodiments antisense oligonucleotides targeted to a STAT3 nucleic acid may be shortened or truncated. For example, a single subunit may be deleted from the 5' end (5' truncation), or alternatively from the 3' end (3' truncation). A shortened or truncated antisense compound targeted to a STAT3 nucleic acid may have two subunits deleted from the 5' end, or alternatively may have two subunits deleted from the 3' end, of the antisense compound. Alternatively, the deleted nucleosides may be dispersed throughout the antisense compound, for example, in an antisense compound having one nucleoside deleted from the 5' end and one nucleoside deleted from the 3' end.

When a single additional subunit is present in a lengthened antisense compound, the additional subunit may be located at the 5' or 3' end of the antisense compound. When two or more additional subunits are present, the added subunits may be adjacent to each other, for example, in an antisense compound having two subunits added to the 5' end (5' addition), or alternatively to the 3' end (3' addition), of the antisense compound. Alternatively, the added subunits may be dispersed throughout the antisense compound, for example, in an antisense compound having one subunit added to the 5' end and one subunit added to the 3' end.

It is possible to increase or decrease the length of an antisense compound, such as an antisense oligonucleotide, and/or introduce mismatch bases without eliminating activity. For example, in Woolf et al. (Proc. Natl. Acad. Sci. USA 89: 7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al. (J. Natl. Cancer Inst. 93:463-471, Mar. 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo.

Maher and Dolnick (Nuc. Acid. Res. 16:3341-3358, 1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

In certain embodiments, the compounds as described herein are efficacious by virtue of having at least one of an in vitro $IC_{50}$ of less than 20 uM, less than 19 uM, less than 18 uM, less than 17 uM, less than 16 uM, less than 15 uM, less than 14 uM, less than 13 uM, less than 12 uM, less than 11 uM, less than 10 uM, less than 9 uM, less than 8 uM, less than 7 uM, less than 6 uM, less than 5 uM, less than 4 uM, less than 3 uM, less than 2 uM, less than 1 uM when delivered to HuVEC cells as described herein.

In certain embodiments, the compounds as described herein are efficacious by virtue of having at least one of an in vitro $IC_{50}$ of less than 1.0 uM, less than 0.9 uM, less than 0.8 uM, less than 0.7 uM, less than 0.6 uM, less than 0.5 uM, less than 0.4 uM, less than 0.3 uM, less than 0.2 uM, less than 0.1 uM when delivered to HuVEC cells as described herein.

In certain embodiments, the compounds as described herein are efficacious by virtue of having at least one of an in vitro $IC_{50}$ of less than 0.95 uM, less than 0.90 uM, less than 0.85 uM, less than 0.80 uM, less than 0.75 uM, less than 0.70 uM, less than 0.65 uM, less than 0.60 uM, less than 0.55 uM, less than 0.50 uM, less than 0.45 uM, less than 0.40 uM, less than 0.35 uM, less than 0.30 uM, less than 0.25 uM, less than 0.20 uM, less than 0.15 uM, less than 0.10 uM, less than 0.05 uM, less than 0.04 uM, less than 0.03 uM, less than 0.02 uM, less than 0.01 uM when delivered to HuVEC cells as described herein.

In certain embodiments, the compound as described herein are efficacious by virtue of having at least one of an in vitro $IC_{50}$ of less of less than 20 uM, less than 15 uM, less than 10 uM, less than 5 uM, less than 2 uM when delivered by free uptake methods to cancer cell lines as described herein.

In certain embodiments, the compounds as described herein are highly tolerable as demonstrated by having at least one of an increase an ALT or AST value of no more than 4 fold, 3 fold, or 2 fold over saline treated animals or an increase in liver, spleen, or kidney weight of no more than 30%, 20%, 15%, 12%, 10%, 5%, or 2%. In certain embodiments, the compounds as described herein are highly tolerable as demonstrated by having no increase of ALT or AST over saline treated animals. In certain embodiments, the compounds as described herein are highly tolerable as demonstrated by having no increase in liver, spleen, or kidney weight over saline treated animals. In certain embodiments, these compounds include ISIS 455265, ISIS 455269, ISIS 455271, ISIS 455272, ISIS 455291, ISIS 455371, ISIS 455394, ISIS 455703, ISIS 455429, ISIS 455471, ISIS 455527, ISIS 455530, ISIS 455536, ISIS 455548, ISIS 455611, ISIS 465236, ISIS 465237, ISIS 465588, ISIS 465740, ISIS 465754, ISIS 465830, ISIS 466670, ISIS 466720; ISIS 481374, ISIS 481390, ISIS 481420, ISIS 481431, ISIS 481453, ISIS 481464, ISIS 481475, ISIS 481495, ISIS 481500, ISIS 481501, ISIS 481525, ISIS 481548, ISIS 481549, ISIS 481597, ISIS 481695, ISIS 481700, ISIS 481702, ISIS 481710, ISIS 481725, ISIS 481750, and ISIS 481763. In certain embodiments, such compounds include compounds comprising the sequence of any one of SEQ ID NOs 57, 90, 90, 175, 223, 245, 267, 307, 317, 318, 366, 411, 413, 54, 258, 268, 272, 288, 464, 367, 393, 1564, 1568, 1571, 1572, 1590, 1670, 1693, 1728, 1770, 1826, 1829, 1835, 1847, 1910, 1997, 2168, 2198, 2325, 2339, 2720, 2731, 2732, and 2756.

Antisense Compound Motifs

In certain embodiments, antisense compounds targeted to a STAT3 nucleic acid have chemically modified subunits arranged in patterns, or motifs, to confer to the antisense compounds properties such as enhanced inhibitory activity, increased binding affinity for a target nucleic acid, or resistance to degradation by in vivo nucleases.

Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound may optionally serve as a substrate for the cellular endonuclease RNase H, which cleaves the RNA strand of an RNA:DNA duplex.

Antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer may in some embodiments include β-D-ribonucleosides, β-D-deoxyribonucleosides, modified nucleosides (such 2'-modified nucleosides may include 2'-MOE and 2'-O—$CH_3$, among others), and bicyclic sugar modified nucleosides (such bicyclic sugar modified nucleosides may include those having a constrained ethyl). In certain embodiments, wings may include several modified sugar moieties, including, for example 2'-MOE and constrained ethyl. In certain embodiments, wings may include several modified and unmodified sugar moieties. In certain embodiments, wings may include various combinations of 2'-MOE nucleosides, constrained ethyl nucleosides, and 2'-deoxynucleosides.

Each distinct region may comprise uniform sugar moieties, variant, or alternating sugar moieties. The wing-gap-wing motif is frequently described as "X-Y-Z", where "X" represents the length of the 5'-wing, "Y" represents the length of the gap, and "Z" represents the length of the 3'-wing. "X" and "Z" may comprise uniform, variant, or alternating sugar moieties. In certain embodiments, "X" and "Y" may include one or more 2'-deoxynucleosides.

"Y" may comprise 2'-deoxynucleosides. As used herein, a gapmer described as "X-Y-Z" has a configuration such that the gap is positioned immediately adjacent to each of the 5'-wing and the 3' wing. Thus, no intervening nucleotides exist between the 5'-wing and gap, or the gap and the 3'-wing. Any of the antisense compounds described herein can have a gapmer motif. In certain embodiments, "X" and "Z" are the same, in other embodiments they are different. In certain embodiments, "Y" is between 8 and 15 nucleosides. X, Y, or Z can be any of 1, 2, 3, 4, 5, 6, 7, 8, 9, 10, 11, 12, 13, 14, 15, 16, 17, 18, 19, 20, 25, 30 or more nucleosides.

In certain embodiments, gapmers provided herein include, for example, 11-mers having a motif of 1-9-1.

In certain embodiments, gapmers provided herein include, for example, 12-mers having a motif of 1-9-2, 2-9-1, or 1-10-1.

In certain embodiments, gapmers provided herein include, for example, 13-mers having a motif of 1-9-3, 2-9-2, 3-9-1, 1-10-2, or 2-10-1.

In certain embodiments, gapmers provided herein include, for example, 14-mers having a motif of 1-9-4, 2-9-3, 3-9-2, 4-9-1, 1-10-3, 2-10-2, or 3-10-1.

In certain embodiments, gapmers provided herein include, for example, 15-mers having a motif of 1-9-5, 2-9-4, 3-9-3, 4-9-2, 5-9-1, 1-10-4, 2-10-3, 3-10-2, or 4-10-1.

In certain embodiments, gapmers provided herein include, for example, 16-mers having a motif of 2-9-5, 3-9-4, 4-9-3, 5-9-2, 1-10-5, 2-10-4, 3-10-3, 4-10-2, or 5-10-1.

In certain embodiments, gapmers provided herein include, for example, 17-mers having a motif of 3-9-5, 4-9-4, 5-9-3, 2-10-5, 3-10-4, 4-10-3, or 5-10-2.

In certain embodiments, gapmers provided herein include, for example, 18-mers having a motif of 4-9-5, 5-9-4, 3-10-5, 4-10-4, or 5-10-3.

In certain embodiments, gapmers provided herein include, for example, 19-mers having a motif of 5-9-5, 4-10-5, or 5-10-4.

In certain embodiments, gapmers provided herein include, for example, 20-mers having a motif of 5-10-5.

In certain embodiments, the antisense compound has a "wingmer" motif, having a wing-gap or gap-wing configuration, i.e. an X-Y or Y-Z configuration as described above for the gapmer configuration. Thus, wingmer configurations provided herein include, but are not limited to, for example 5-10, 8-4, 4-12, 12-4, 3-14, 16-2, 18-1, 10-3, 2-10, 1-10, 8-2, 2-13, 5-13, 5-8, or 6-8.

In certain embodiments, antisense compound targeted to a STAT3 nucleic acid has a 2-10-2 gapmer motif.

In certain embodiments, the antisense compound targeted to a STAT3 nucleic acid has a 3-10-3 gapmer motif.

In certain embodiments, the antisense compound targeted to a STAT3 nucleic acid has a 5-10-5 gapmer motif.

In certain embodiments, the antisense compound targeted to a STAT3 nucleic acid has a 1-10-5 gapmer motif.

In certain embodiments, the antisense compound targeted to a STAT3 nucleic acid has a 3-10-4 gapmer motif.

In certain embodiments, the antisense compound targeted to a STAT3 nucleic acid has a 2-10-4 gapmer motif.

In certain embodiments, the antisense compound targeted to a STAT3 nucleic acid has a 4-9-3 gapmer motif.

In certain embodiments, the antisense compound targeted to a STAT3 nucleic acid has a gap-widened motif.

In certain embodiments, the antisense compounds targeted to a STAT3 nucleic acid has any of the following sugar motifs:

k-d(10)-k
e-d(10)-k
k-d(10)-e
k-k-d(10)-k-k
k-k-d(10)-e-e
e-e-d(10)-k-k
k-k-k-d(10)-k-k-k
e-e-e-d(10)-k-k-k
k-k-k-d(10)-e-e-e
k-k-k-d(10)-k-k-k
e-k-k-d(10)-k-k-e
e-e-k-d(10)-k-k-e
e-d-k-d(10)-k-k-e
e-k-d(10)-k-e-k-e
k-d(10)-k-e-k-e-e
e-e-k-d(10)-k-e-k-e
e-d-d-k-d(9)-k-k-e
e-e-e-e-d(9)-k-k-e wherein, k is a constrained ethyl nucleoside, e is a 2'-MOE substituted nucleoside, and d is a 2'-deoxynucleoside.

In certain embodiments, the antisense oligonucleotide has a sugar motif described by Formula A as follows: $(J)_m\text{-}(B)_n\text{-}M_p\text{-}(B)_r\text{-}(A)_t\text{-}(D)_g\text{-}(A)_t\text{-}(B)_w\text{-}(J)_x\text{-}(B)_y\text{-}(J)_z$ wherein:
each A is independently a 2'-substituted nucleoside;
each B is independently a bicyclic nucleoside;
each J is independently either a 2'-substituted nucleoside or a 2'-deoxynucleoside;
each D is a 2'-deoxynucleoside;
m is 0-4; n is 0-2; p is 0-2; r is 0-2; t is 0-2; v is 0-2; w is 0-4; x is 0-2; y is 0-2; z is 0-4; g is 6-14;

provided that:
at least one of m, n, and r is other than 0;
at least one of w and y is other than 0;
the sum of m, n, p, r, and t is from 2 to 5; and
the sum of v, w, x, y, and z is from 2 to 5.

Target Nucleic Acids, Target Regions and Nucleotide Sequences

Nucleotide sequences that encode STAT3 include, without limitation, the following: GENBANK Accession No. NM_139276.2 (incorporated herein as SEQ ID NO: 1) and the complement of GENBANK Accession No. NT_010755.14 truncated from nucleotides 4185000 to 4264000 (incorporated herein as SEQ ID NO: 2).

It is understood that the sequence set forth in each SEQ ID NO in the Examples contained herein is independent of any modification to a sugar moiety, an internucleoside linkage, or a nucleobase. As such, antisense compounds defined by a SEQ ID NO may comprise, independently, one or more modifications to a sugar moiety, an internucleoside linkage, or a nucleobase. Antisense compounds described by Isis Number (Isis No) indicate a combination of nucleobase sequence and motif.

In certain embodiments, a target region is a structurally defined region of the target nucleic acid. For example, a target region may encompass a 3' UTR, a 5' UTR, an exon, an intron, an exon/intron junction, a coding region, a translation initiation region, translation termination region, or other defined nucleic acid region. The structurally defined regions for STAT3 can be obtained by accession number from sequence databases such as NCBI and such information is incorporated herein by reference. In certain embodiments, a target region may encompass the sequence from a 5' target site of one target segment within the target region to a 3' target site of another target segment within the same target region.

Targeting includes determination of at least one target segment to which an antisense compound hybridizes, such that a desired effect occurs. In certain embodiments, the desired effect is a reduction in mRNA target nucleic acid levels. In certain embodiments, the desired effect is reduction of levels of protein encoded by the target nucleic acid or a phenotypic change associated with the target nucleic acid.

A target region may contain one or more target segments. Multiple target segments within a target region may be overlapping. Alternatively, they may be non-overlapping. In certain embodiments, target segments within a target region are separated by no more than about 300 nucleotides. In certain emodiments, target segments within a target region are separated by a number of nucleotides that is, is about, is no more than, is no more than about, 250, 200, 150, 100, 90, 80, 70, 60, 50, 40, 30, 20, or 10 nucleotides on the target nucleic acid, or is a range defined by any two of the preceeding values. In certain embodiments, target segments within a target region are separated by no more than, or no more than about, 5 nucleotides on the target nucleic acid. In certain embodiments, target segments are contiguous. Contemplated are target regions defined by a range having a starting nucleic acid that is any of the 5' target sites or 3' target sites listed herein.

Suitable target segments may be found within a 5' UTR, a coding region, a 3' UTR, an intron, an exon, or an exon/intron junction. Target segments containing a start codon or a stop codon are also suitable target segments. A suitable target segment may specifically exclude a certain structurally defined region such as the start codon or stop codon.

The determination of suitable target segments may include a comparison of the sequence of a target nucleic acid to other sequences throughout the genome. For example, the BLAST algorithm may be used to identify regions of similarity amongst different nucleic acids. This comparison can prevent the selection of antisense compound sequences that may hybridize in a non-specific manner to sequences other than a selected target nucleic acid (i.e., non-target or off-target sequences).

There may be variation in activity (e.g., as defined by percent reduction of target nucleic acid levels) of the antisense compounds within an active target region. In certain embodiments, reductions in STAT3 mRNA levels are indicative of inhibition of STAT3 expression. Reductions in levels of a STAT3 protein are also indicative of inhibition of target mRNA expression. Further, phenotypic changes are indicative of inhibition of STAT3 expression. In certain embodiments, reduced cellular growth, reduced tumor growth, and reduced tumor volume can be indicative of inhibition of STAT3 expression. In certain embodiments, amelioration of symptoms associated with cancer can be indicative of inhibition of STAT3 expression. In certain embodiments, reduction of cachexia is indicative of inhibition of STAT3 expression. In certain embodiments, reduction of cancer markers can be indicative of inhibition of STAT3 expression.

Hybridization

In some embodiments, hybridization occurs between an antisense compound disclosed herein and a STAT3 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art. In certain embodiments, the antisense compounds provided herein are specifically hybridizable with a STAT3 nucleic acid.

Complementarity

An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as a STAT3 nucleic acid).

Non-complementary nucleobases between an antisense compound and a STAT3 nucleic acid may be tolerated provided that the antisense compound remains able to specifically hybridize to a target nucleic acid. Moreover, an antisense compound may hybridize over one or more segments of a STAT3 nucleic acid such that intervening or adjacent segments are not involved in the hybridization event (e.g., a loop structure, mismatch or hairpin structure).

In certain embodiments, the antisense compounds provided herein, or a specified portion thereof, are, or are at least, 70%, 80%, 85%, 86%, 87%, 88%, 89%, 90%, 91%, 92%, 93%, 94%, 95%, 96%, 97%, 98%, 99%, or 100% complementary to a STAT3 nucleic acid, a target region, target segment, or specified portion thereof. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases may be clustered or interspersed with complementary nucleobases and need not be contiguous to each other or to complementary nucleobases. As such, an antisense compound which is 18 nucleobases in length having four noncomplementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e. 100% complementary) to a target nucleic acid, or specified portion thereof. For example, an antisense compound may be fully complementary to a STAT3 nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound may or may not be fully complementary to the target sequence, depending on whether the remaining 10 nucleobases of the antisense compound are also complementary to the target sequence.

The location of a non-complementary nucleobase may be at the 5' end or 3' end of the antisense compound. Alternatively, the non-complementary nucleobase or nucleobases may be at an internal position of the antisense compound. When two or more non-complementary nucleobases are present, they may be contiguous (i.e. linked) or non-contiguous. In one embodiment, a non-complementary nucleobase is located in the wing segment of a gapmer antisense oligonucleotide.

In certain embodiments, antisense compounds that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a STAT3 nucleic acid, or specified portion thereof.

In certain embodiments, antisense compounds that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a STAT3 nucleic acid, or specified portion thereof.

The antisense compounds provided herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 9 nucleobase portion of a target segment. In certain embodiments, the antisense compounds are complementary to at least a 10 nucleobase portion of a target segment. In certain embodiments, the antisense compounds are complementary to at least an 11 nucleobase portion of a target segment. In certain embodiments, the antisense compounds are complementary to at least a 12 nucleobase portion of a target segment. In certain embodiments, the antisense compounds are complementary to at least a 13 nucleobase portion of a target segment. In certain embodiments, the antisense compounds are complementary to at least a 14 nucleobase portion of a target segment. In certain embodiments, the antisense compounds are complementary to at least a 15 nucleobase portion of a target segment. Also contemplated are antisense compounds that are complementary to at least a 9, 10, 11, 12, 13, 14, 15, 16, 17, 18, 19, 20, or more nucleobase portion of a target segment, or a range defined by any two of these values.

Identity

The antisense compounds provided herein may also have a defined percent identity to a particular nucleotide sequence, SEQ ID NO, or compound represented by a specific Isis number, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases may be adjacent to each other or dispersed throughout the antisense compound. Percent identity of an antisense compound is calculated according to the number of bases that have identical base pairing relative to the sequence to which it is being compared.

In certain embodiments, the antisense compounds, or portions thereof, are at least 70%, 75%, 80%, 85%, 90%, 95%, 96%, 97%, 98%, 99% or 100% identical to one or more of the antisense compounds or SEQ ID NOs, or a portion thereof, disclosed herein.

In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, a portion of the antisense oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Modifications

A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2',3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides may also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to a STAT3 nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

Modified Sugar Moieties

Antisense compounds provided herein can optionally contain one or more nucleosides wherein the sugar group has been modified. Such sugar modified nucleosides may impart enhanced nuclease stability, increased binding affinity, or some other beneficial biological property to the antisense compounds. In certain embodiments, nucleosides comprise a chemically modified ribofuranose ring moiety. Examples of chemically modified ribofuranose rings include, without limitation, addition of substituent groups (including 5' and 2' substituent groups); bridging of non-geminal ring atoms to form bicyclic nucleic acids (BNA); replacement of the ribosyl ring oxygen atom with S, N(R), or C(R1)(R)$_2$ (R═H, C$_1$-C$_{12}$ alkyl or a protecting group); and combinations thereof. Examples of chemically modified sugars include, 2'-F-5'-methyl substituted nucleoside (see, PCT International Application WO 2008/101157, published on Aug. 21, 2008 for other disclosed 5',2'-bis substituted nucleosides), replacement of the ribosyl ring oxygen atom with S with further substitution at the 2'-position (see, published U.S. Patent Application US2005/0130923, published on Jun. 16, 2005), or, alternatively, 5'-substitution of a BNA (see, PCT International Application WO 2007/134181, published on Nov. 22, 2007, wherein LNA is substituted with, for example, a 5'-methyl or a 5'-vinyl group).

Examples of nucleosides having modified sugar moieties include, without limitation, nucleosides comprising 5'-vinyl, 5'-methyl (R or S), 4'-S, 2'-F, 2'-OCH$_3$, and 2'-O(CH$_2$)2OCH$_3$ substituent groups. The substituent at the 2' position can also be selected from allyl, amino, azido, thio, O-allyl, O—C$_1$-C$_{10}$ alkyl, OCF$_3$, O(CH$_2$)$_2$SCH$_3$, O(CH$_2$)$_2$—O—N(Rm)(Rn), and O—CH$_2$—C(═O)—N(Rm)(Rn), where each Rm and Rn is, independently, H or substituted or unsubstituted C$_1$-C$_{10}$ alkyl.

As used herein, "bicyclic nucleosides" refer to modified nucleosides comprising a bicyclic sugar moiety. Examples of bicyclic nucleosides include, without limitation, nucleosides comprising a bridge between the 4' and the 2' ribosyl ring atoms. In certain embodiments, antisense compounds provided herein include one or more bicyclic nucleosides wherein the bridge comprises a 4' to 2' bicyclic nucleoside. Examples of such 4' to 2' bicyclic nucleosides, include, but are not limited to, one of the formulae: 4'-(CH$_2$)—O-2' (LNA); 4'-(CH$_2$)—S-2'; 4'-(CH$_2$)$_2$—O-2' (ENA); 4'-CH(CH$_3$)—O-2' and 4'-CH(CH$_2$OCH$_3$)—O-2', and analogs thereof (see, U.S. Pat. No. 7,399,845, issued on Jul. 15, 2008); 4'-C(CH$_3$)(CH$_3$)—O-2', and analogs thereof (see, published PCT International Application WO2009/006478, published Jan. 8, 2009); 4'-CH$_2$—N(OCH$_3$)-2', and analogs thereof (see, published PCT International Application WO2008/150729, published Dec. 11, 2008); 4'-CH$_2$—O—N(CH$_3$)-2' (see, published U.S. Patent Application US2004/0171570, published Sep. 2, 2004); 4'-CH$_2$—N(R)—O-2', wherein R is H, C$_1$-C$_{12}$ alkyl, or a protecting group (see, U.S. Pat. No. 7,427,672, issued on Sep. 23, 2008); 4'-CH$_2$—C(H)(CH$_3$)-2' (see, Chattopadhyaya, et al., *J. Org. Chem.*, 2009, 74, 118-134); and 4'-CH$_2$—C(═CH$_2$)-2', and analogs thereof (see, published PCT International Application WO 2008/154401, published on Dec. 8, 2008). Also see, for example: Singh et al., *Chem. Commun.*, 1998, 4, 455-456; Koshkin et al., Tetrahedron, 1998, 54, 3607-3630; Wahlestedt et al., *Proc. Natl. Acad. Sci. U.S. A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 129(26) 8362-8379 (Jul. 4, 2007); Elayadi et al., *Curr. Opinion Invens. Drugs*, 2001, 2, 558-561; Braasch et al., *Chem. Biol.*, 2001, 8, 1-7; Orum et al., *Curr. Opinion Mol. Ther.*, 2001, 3, 239-243; U.S. Pat. Nos. 6,670,461, 7,053,207, 6,268,490, 6,770,748, 6,794,499, 7,034,133, 6,525,191, 7,399,845; published PCT International applications WO 2004/106356, WO 94/14226, WO 2005/021570, and WO 2007/134181; U.S. Patent Publication Nos. US2004/0171570, US2007/0287831, and US2008/0039618; and U.S. patent Ser. Nos. 12/129,154, 60/989,574, 61/026,995, 61/026,998, 61/056,564, 61/086,231, 61/097,787, and 61/099, 844; and PCT International Application Nos. PCT/US2008/064591, PCT/US2008/066154, and PCT/US2008/068922. Each of the foregoing bicyclic nucleosides can be prepared having one or more stereochemical sugar configurations including for example α-L-ribofuranose and β-D-ribofuranose (see PCT international application PCT/DK98/00393, published on Mar. 25, 1999 as WO 99/14226).

In certain embodiments, bicyclic sugar moieties of BNA nucleosides include, but are not limited to, compounds having at least one bridge between the 4' and the 2' position of the pentofuranosyl sugar moiety wherein such bridges independently comprises 1 or from 2 to 4 linked groups independently selected from —[C(R$_a$)(R$_b$)]$_n$—, —C(R$_a$)═C(R$_b$)—, —C(R$_a$)═N—, —C(═NR$_a$)—, —C(═O)—, —C(═S)—, —O—, —Si(R$_a$)$_2$—, —S(═O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(═O)—H), substituted acyl, CN, sulfonyl (S(═O)$_2$-J$_1$), or sulfoxyl (S(═O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(═O)—H), substituted acyl, a heterocycle radical, a substituted heterocycle radical, C$_1$-C$_{12}$ aminoalkyl, substituted C$_1$-C$_{12}$ aminoalkyl, or a protecting group.

In certain embodiments, the bridge of a bicyclic sugar moiety is, —[C(R$_a$)(R$_b$)]$_n$—, —[C(R$_a$)(R$_b$)]$_n$—O—, —C(R$_a$R$_b$)—N(R)—O— or, —C(R$_a$R$_b$)—O—N(R)—. In certain embodiments, the bridge is 4'-CH$_2$-2',4'-(CH$_2$)$_2$-2',4'-(CH$_2$)$_3$-2',4'-CH$_2$—O-2',4'-(CH$_2$)$_2$—O-2',4'-CH$_2$—O—N(R)-2', and 4'-CH$_2$—N(R)—O-2'-, wherein each R is, independently, H, a protecting group, or C$_1$-C$_{12}$ alkyl.

In certain embodiments, bicyclic nucleosides are further defined by isomeric configuration. For example, a nucleoside comprising a 4'-2' methylene-oxy bridge, may be in the α-L configuration or in the β-D configuration. Previously, α-L-methyleneoxy (4'-CH$_2$—O-2') BNA's have been incorporated into antisense oligonucleotides that showed antisense activity (Frieden et al., *Nucleic Acids Research*, 2003, 21, 6365-6372).

In certain embodiments, bicyclic nucleosides include, but are not limited to, (A) α-L-Methyleneoxy (4'-CH$_2$—O-2') BNA, (B) β-D-Methyleneoxy (4'-CH$_2$—O-2') BNA, (C) Ethyleneoxy (4'40-(CH$_2$)$_2$—O-2') BNA, (D) Aminooxy (4'-CH$_2$—O—N(R)-2') BNA, (E) Oxyamino (4'-CH$_2$—N(R)—O-2') BNA, (F) Methyl(methyleneoxy) (4'-CH(CH$_3$)—O-2') BNA, (G) methylene-thio (4'-CH$_2$—S-2') BNA, (H) methylene-amino (4'-CH2-N(R)-2') BNA, (I) methyl carbocyclic (4'-CH$_2$—CH(CH$_3$)-2') BNA, and (J) propylene carbocyclic (4'-(CH$_2$)$_3$-2') BNA as depicted below.

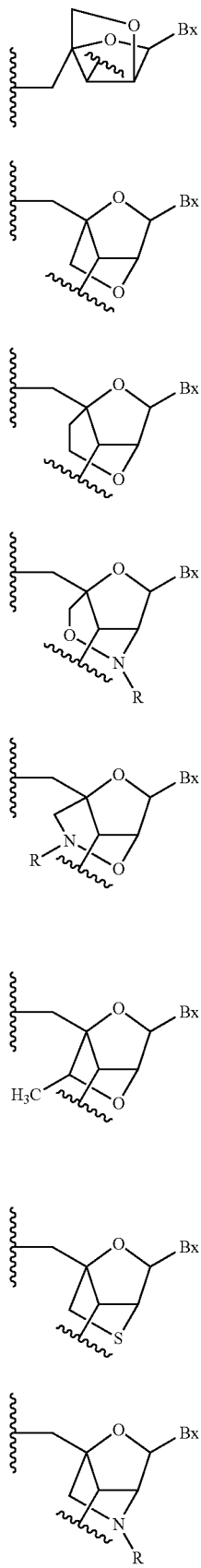

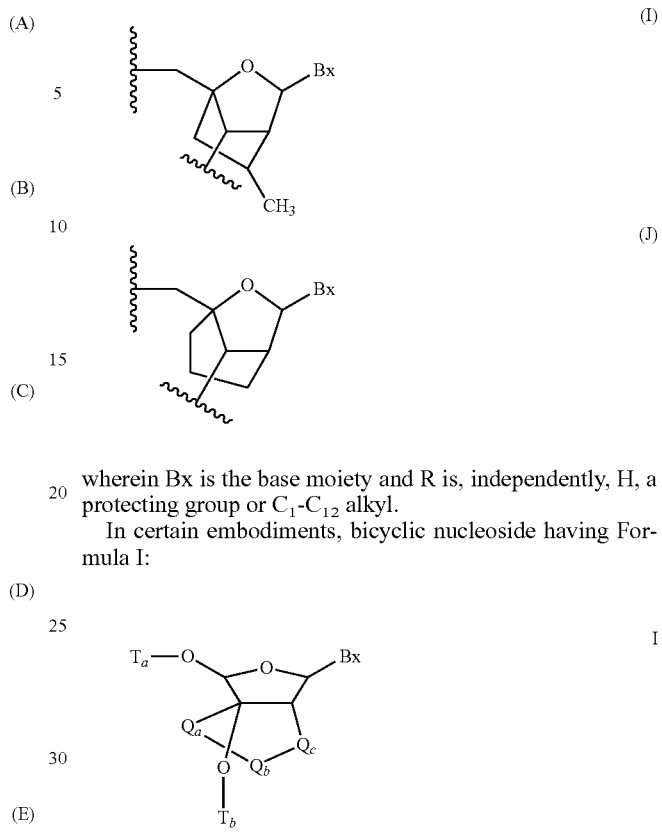

wherein Bx is the base moiety and R is, independently, H, a protecting group or $C_1$-$C_{12}$ alkyl.

In certain embodiments, bicyclic nucleoside having Formula I:

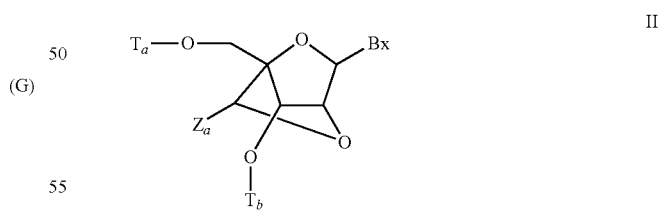

wherein:
Bx is a heterocyclic base moiety;
-$Q_a$-$Q_b$-$Q_c$- is —$CH_2$—N($R_c$)—$CH_2$—, —C(=O)—N($R_c$)—$CH_2$—, —$CH_2$—O—N($R_c$)—, —$CH_2$—N($R_c$)—O—, or —N($R_c$)—O—$CH_2$;
$R_c$ is $C_1$-$C_{12}$ alkyl or an amino protecting group; and
$T_a$ and $T_b$ are each, independently, H, a hydroxyl protecting group, a conjugate group, a reactive phosphorus group, a phosphorus moiety, or a covalent attachment to a support medium.

In certain embodiments, bicyclic nucleoside having Formula II:

wherein:
Bx is a heterocyclic base moiety;
$T_a$ and $T_b$ are each, independently, H, a hydroxyl protecting group, a conjugate group, a reactive phosphorus group, a phosphorus moiety, or a covalent attachment to a support medium;
$Z_a$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, substituted amide, thiol, or substituted thio.

In one embodiment, each of the substituted groups is, independently, mono or poly substituted with substituent groups independently selected from halogen, oxo, hydroxyl, $OJ_c$, $NJ_cJ_d$, $SJ_c$, $N_3$, $OC(=X)J_c$, and $NJ_eC(=X)NJ_cJ_d$, wherein each $J_o$, $J_d$, and $J_e$ is, independently, H, $C_1$-$C_6$ alkyl, or substituted $C_1$-$C_6$ alkyl and X is O or $NJ_c$.

In certain embodiments, bicyclic nucleoside having Formula III:

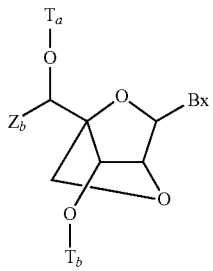

III wherein:

Bx is a heterocyclic base moiety;

$T_a$ and $T_b$ are each, independently, H, a hydroxyl protecting group, a conjugate group, a reactive phosphorus group, a phosphorus moiety, or a covalent attachment to a support medium;

$Z_b$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, or substituted acyl (C(=O)—).

In certain embodiments, bicyclic nucleoside having Formula IV:

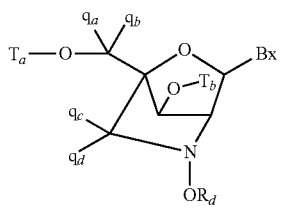

IV wherein:

Bx is a heterocyclic base moiety;

$T_a$ and $T_b$ are each, independently H, a hydroxyl protecting group, a conjugate group, a reactive phosphorus group, a phosphorus moiety, or a covalent attachment to a support medium;

$R_d$ is $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl;

each $q_a$, $q_b$, $q_c$ and $q_d$ is, independently, H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl, $C_1$-$C_6$ alkoxyl, substituted $C_1$-$C_6$ alkoxyl, acyl, substituted acyl, $C_1$-$C_6$ aminoalkyl, or substituted $C_1$-$C_6$ aminoalkyl;

In certain embodiments, bicyclic nucleoside having Formula V:

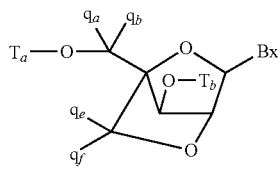

V wherein:

Bx is a heterocyclic base moiety;

$T_a$ and $T_b$ are each, independently, H, a hydroxyl protecting group, a conjugate group, a reactive phosphorus group, a phosphorus moiety, or a covalent attachment to a support medium;

$q_a$, $q_b$, $q_e$ and $q_f$ are each, independently, hydrogen, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxy, substituted $C_1$-$C_{12}$ alkoxy, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$;

or $q_e$ and $q_f$ together are =C($q_g$)($q_h$);

$q_g$ and $q_h$ are each, independently, H, halogen, $C_1$-$C_{12}$ alkyl, or substituted $C_1$-$C_{12}$ alkyl.

The synthesis and preparation of the methyleneoxy (4'-$CH_2$—O-2') BNA monomers adenine, cytosine, guanine, 5-methyl-cytosine, thymine, and uracil, along with their oligomerization, and nucleic acid recognition properties have been described (see, e.g., Koshkin et al., *Tetrahedron*, 1998, 54, 3607-3630). BNAs and preparation thereof are also described in WO 98/39352 and WO 99/14226.

Analogs of methyleneoxy (4'-$CH_2$—O-2') BNA, methyleneoxy (4'-$CH_2$—O-2') BNA, and 2'-thio-BNAs, have also been prepared (see, e.g., Kumar et al., *Bioorg. Med. Chem. Lett.*, 1998, 8, 2219-2222).

Preparation of locked nucleoside analogs comprising oligodeoxyribonucleotide duplexes as substrates for nucleic acid polymerases has also been described (see, e.g., Wengel et al., WO 99/14226). Furthermore, synthesis of 2'-amino-BNA, a novel comformationally restricted high-affinity oligonucleotide analog, has been described in the art (see, e.g., Singh et al., *J. Org. Chem.*, 1998, 63, 10035-10039). In addition, 2'-amino- and 2'-methylamino-BNA's have been prepared and the thermal stability of their duplexes with complementary RNA and DNA strands has been previously reported.

In certain embodiments, bicyclic nucleoside having Formula VI:

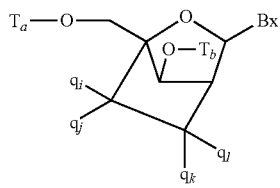

VI wherein:

Bx is a heterocyclic base moiety;

$T_a$ and $T_b$ are each, independently, H, a hydroxyl protecting group, a conjugate group, a reactive phosphorus group, a phosphorus moiety, or a covalent attachment to a support medium;

each $q_i$, $q_j$, $q_k$ and $q_l$ is, independently, H, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxyl, substituted $C_1$-$C_{12}$ alkoxyl, $OJ_j$, $SJ_j$, $SOJ_j$, $SO_2J_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$, or N(H)C(=S)$NJ_jJ_k$; and $q_i$ and $q_j$ or $q_l$ and $q_k$ together are =C($q_g$)($q_h$), wherein $q_g$ and $q_h$ are each, independently, H, halogen, $C_1$-$C_{12}$ alkyl, or substituted $C_1$-$C_{12}$ alkyl.

One carbocyclic bicyclic nucleoside having a 4'-(CH$_2$)$_3$-2' bridge and the alkenyl analog, bridge 4'-CH=CH—CH$_2$-2', have been described (see, e.g., Freier et al., *Nucleic Acids Research*, 1997, 25(22), 4429-4443 and Albaek et al., *J. Org. Chem.*, 2006, 71, 7731-7740). The synthesis and preparation of carbocyclic bicyclic nucleosides along with their oligomerization and biochemical studies have also been described (see, e.g., Srivastava et al., *J. Am. Chem. Soc.* 2007, 129(26), 8362-8379).

As used herein, "4'-2' bicyclic nucleoside" or "4' to 2' bicyclic nucleoside" refers to a bicyclic nucleoside comprising a furanose ring comprising a bridge connecting the 2' carbon atom and the 4' carbon atom.

As used herein, "monocylic nucleosides" refer to nucleosides comprising modified sugar moieties that are not bicyclic sugar moieties. In certain embodiments, the sugar moiety, or sugar moiety analogue, of a nucleoside may be modified or substituted at any position.

As used herein, "2'-modified sugar" means a furanosyl sugar modified at the 2' position. In certain embodiments, such modifications include substituents selected from: a halide, including, but not limited to substituted and unsubstituted alkoxy, substituted and unsubstituted thioalkyl, substituted and unsubstituted amino alkyl, substituted and unsubstituted alkyl, substituted and unsubstituted allyl, and substituted and unsubstituted alkynyl. In certain embodiments, 2' modifications are selected from substituents including, but not limited to: O[(CH$_2$)$_n$O]$_m$CH$_3$, O(CH$_2$)$_n$NH$_2$, O(CH$_2$)$_n$CH$_3$, O(CH$_2$)$_n$ONH$_2$, OCH$_2$C(=O)N(H)CH$_3$, and O(CH$_2$)$_n$ON[(CH$_2$)$_n$CH$_3$]$_2$, where n and m are from 1 to about 10. Other 2'-substituent groups can also be selected from: $C_1$-$C_{12}$ alkyl; substituted alkyl; alkenyl; alkynyl; alkaryl; aralkyl; O-alkaryl or O-aralkyl; SH; SCH$_3$; OCN; Cl; Br; CN; CF$_3$; OCF$_3$; SOCH$_3$; SO$_2$CH$_3$; ONO$_2$; NO$_2$; N$_3$; NH$_2$; heterocycloalkyl; heterocycloalkaryl; aminoalkylamino; polyalkylamino; substituted silyl; an RNA cleaving group; a reporter group; an intercalator; a group for improving pharmacokinetic properties; and a group for improving the pharmacodynamic properties of an antisense compound, and other substituents having similar properties. In certain embodiments, modified nucleosides comprise a 2'-MOE side chain (see, e.g., Baker et al., J. Biol. Chem., 1997, 272, 11944-12000). Such 2'-MOE substitution have been described as having improved binding affinity compared to unmodified nucleosides and to other modified nucleosides, such as 2'-O-methyl, O-propyl, and O-aminopropyl. Oligonucleotides having the 2'-MOE substituent also have been shown to be antisense inhibitors of gene expression with promising features for in vivo use (see, e.g., Martin, P., *Helv. Chim. Acta*, 1995, 78, 486-504; Altmann et al., Chimia, 1996, 50, 168-176; Altmann et al., *Biochem. Soc. Trans.*, 1996, 24, 630-637; and Altmann et al., *Nucleosides Nucleotides*, 1997, 16, 917-926).

As used herein, a "modified tetrahydropyran nucleoside" or "modified THP nucleoside" means a nucleoside having a six-membered tetrahydropyran "sugar" substituted in for the pentofuranosyl residue in normal nucleosides (a sugar surrogate). Modified THP nucleosides include, but are not limited to, what is referred to in the art as hexitol nucleic acid (HNA), anitol nucleic acid (ANA), manitol nucleic acid (MNA) (see Leumann, C J. *Bioorg. & Med. Chem.* (2002) 10:841-854), fluoro HNA (F-HNA), or those compounds having Formula X:

Formula X:

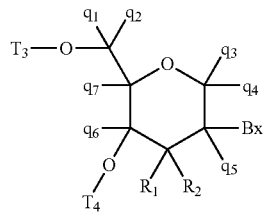

wherein independently for each of said at least one tetrahydropyran nucleoside analog of Formula X:

Bx is a heterocyclic base moiety;

$T_3$ and $T_4$ are each, independently, an internucleoside linking group linking the tetrahydropyran nucleoside analog to the antisense compound or one of $T_3$ and $T_4$ is an internucleoside linking group linking the tetrahydropyran nucleoside analog to the antisense compound and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and one of $R_1$ and $R_2$ is hydrogen and the other is selected from halogen, substituted or unsubstituted alkoxy, $NJ_1J_2$, $SJ_1$, $N_3$, OC(=X)$J_1$, OC(')ONJ$_1$J$_2$, NJ$_3$C(=X)NJ$_1$J$_2$, and CN, wherein X is O, S, or NJ$_1$, and each $J_1$, $J_2$, and $J_3$ is, independently, H or $C_1$-$C_6$ alkyl.

In certain embodiments, the modified THP nucleosides of Formula X are provided wherein $q_m$, $q_n$, $q_p$, $q_r$, $q_s$, $q_t$, and $q_u$ are each H. In certain embodiments, at least one of $q_m$, $q_n$, $q_o$, $q_p$, $q_r$, $q_s$, $q_t$, and $q_u$ is other than H. In certain embodiments, at least one of $q_m$, $q_n$, $q_p$, $q_r$, $q_s$, $q_t$ and $q_u$ is methyl. In certain embodiments, THP nucleosides of Formula X are provided wherein one of $R_1$ and $R_2$ is F. In certain embodiments, $R_1$ is fluoro and $R_2$ is H, $R_1$ is methoxy and $R_2$ is H, and $R_1$ is methoxyethoxy and $R_2$ is H.

As used herein, "2'-modified" or "2'-substituted" refers to a nucleoside comprising a sugar comprising a substituent at the 2' position other than H or OH. 2'-modified nucleosides, include, but are not limited to, bicyclic nucleosides wherein the bridge connecting two carbon atoms of the sugar ring connects the 2' carbon and another carbon of the sugar ring and nucleosides with non-bridging 2' substituents, such as allyl, amino, azido, thio, O-allyl, O—$C_1$-$C_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), or O—CH$_2$—C(=O)—N(R$_m$)(R$_n$), where each $R_m$ and $R_n$ is, independently, H or substituted or unsubstituted $C_1$-$C_{10}$ alkyl. 2'-modified nucleosides may further comprise other modifications, for example, at other positions of the sugar and/or at the nucleobase.

As used herein, "2'-F" refers to a sugar comprising a fluoro group at the 2' position.

As used herein, "2'-OMe" or "2'-OCH$_3$" or "2'-O-methyl" each refers to a nucleoside comprising a sugar comprising an —OCH$_3$ group at the 2' position of the sugar ring.

As used herein, "oligonucleotide" refers to a compound comprising a plurality of linked nucleosides.

In certain embodiments, one or more of the plurality of nucleosides is modified. In certain embodiments, an oligonucleotide comprises one or more ribonucleosides (RNA) and/or deoxyribonucleosides (DNA).

Many other bicyclo and tricyclo sugar surrogate ring systems are also known in the art that can be used to modify nucleosides for incorporation into antisense compounds (see, e.g., review article: Leumann, J. C, *Bioorganic & Medicinal Chemistry*, 2002, 10, 841-854). Such ring systems can undergo various additional substitutions to enhance activity.

Methods for the preparations of modified sugars are well known to those skilled in the art.

In nucleotides having modified sugar moieties, the nucleobase moieties (natural, modified, or a combination thereof) are maintained for hybridization with an appropriate nucleic acid target.

In certain embodiments, antisense compounds comprise one or more nucleotides having modified sugar moieties. In certain embodiments, the modified sugar moiety is 2'-MOE. In certain embodiments, the 2'-MOE modified nucleotides are arranged in a gapmer motif. In certain embodiments, the modified sugar moiety is a cEt. In certain embodiments, the cEt modified nucleotides are arranged throughout the wings of a gapmer motif.

Compositions and Methods for Formulating Pharmaceutical Compositions

Antisense oligonucleotides may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

An antisense compound targeted to a STAT3 nucleic acid can be utilized in pharmaceutical compositions by combining the antisense compound with a suitable pharmaceutically acceptable diluent or carrier. A pharmaceutically acceptable diluent includes phosphate-buffered saline (PBS). PBS is a diluent suitable for use in compositions to be delivered parenterally. Accordingly, in one embodiment, employed in the methods described herein is a pharmaceutical composition comprising an antisense compound targeted to a STAT3 nucleic acid and a pharmaceutically acceptable diluent. In certain embodiments, the pharmaceutically acceptable diluent is PBS. In certain embodiments, the antisense compound is an antisense oligonucleotide.

Pharmaceutical compositions comprising antisense compounds encompass any pharmaceutically acceptable salts, esters, or salts of such esters, or any other oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an antisense compound which are cleaved by endogenous nucleases within the body, to form the active antisense compound.

Conjugated Antisense Compounds

Antisense compounds may be covalently linked to one or more moieties or conjugates which enhance the activity, cellular distribution or cellular uptake of the resulting antisense oligonucleotides. Typical conjugate groups include cholesterol moieties and lipid moieties. Additional conjugate groups include carbohydrates, phospholipids, biotin, phenazine, folate, phenanthridine, anthraquinone, acridine, fluoresceins, rhodamines, coumarins, and dyes.

Antisense compounds can also be modified to have one or more stabilizing groups that are generally attached to one or both termini of antisense compounds to enhance properties such as, for example, nuclease stability. Included in stabilizing groups are cap structures. These terminal modifications protect the antisense compound having terminal nucleic acid from exonuclease degradation, and can help in delivery and/or localization within a cell. The cap can be present at the 5'-terminus (5'-cap), or at the 3'-terminus (3'-cap), or can be present on both termini. Cap structures are well known in the art and include, for example, inverted deoxy a basic caps. Further 3' and 5'-stabilizing groups that can be used to cap one or both ends of an antisense compound to impart nuclease stability include those disclosed in WO 03/004602 published on Jan. 16, 2003.

Cell Culture and Antisense Compounds Treatment

The effects of antisense compounds on the level, activity or expression of STAT3 nucleic acids can be tested in vitro in a variety of cell types. Cell types used for such analyses are available from commercial vendors (e.g. American Type Culture Collection, Manassus, Va.; Zen-Bio, Inc., Research Triangle Park, N.C.; Clonetics Corporation, Walkersville, Md.) and are cultured according to the vendor's instructions using commercially available reagents (e.g. Invitrogen Life Technologies, Carlsbad, Calif.). Illustrative cell types include, but are not limited to, HuVEC cells, b.END cells, HepG2 cells, Hep3B cells, and primary hepatocytes.

In Vitro Testing of Antisense Oligonucleotides

Described herein are methods for treatment of cells with antisense oligonucleotides, which can be modified appropriately for treatment with other antisense compounds.

Cells may be treated with antisense oligonucleotides when the cells reach approximately 60-80% confluency in culture.

One reagent commonly used to introduce antisense oligonucleotides into cultured cells includes the cationic lipid transfection reagent LIPOFECTIN (Invitrogen, Carlsbad, Calif.). Antisense oligonucleotides may be mixed with LIPOFECTIN in OPTI-MEM 1 (Invitrogen, Carlsbad, Calif.) to achieve the desired final concentration of antisense oligonucleotide and a LIPOFECTIN concentration that may range from 2 to 12 ug/mL per 100 nM antisense oligonucleotide.

Another reagent used to introduce antisense oligonucleotides into cultured cells includes LIPOFECTAMINE (Invitrogen, Carlsbad, Calif.). Antisense oligonucleotide is mixed with LIPOFECTAMINE in OPTI-MEM 1 reduced serum medium (Invitrogen, Carlsbad, Calif.) to achieve the desired concentration of antisense oligonucleotide and a LIPOFECTAMINE concentration that may range from 2 to 12 ug/mL per 100 nM antisense oligonucleotide.

Another technique used to introduce antisense oligonucleotides into cultured cells includes electroporation.

Cells are treated with antisense oligonucleotides by routine methods. Cells may be harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM when transfected with LIPOFECTAMINE. Antisense oligonucleotides are used at higher concentrations ranging from 625 to 20,000 nM when transfected using electroporation.

Free Uptake Assays

In certain embodiments, transfection-independent activity (i.e., free uptake) of antisense oligonucleotides in cancer cell lines is a measure of potency. Free uptake may be measured in cancer cell lines such as, for example, SK-BR-3 cells, U251-MG cells, MDA-MB-231 cells, 11460 cells, A431 cells, colo205 cells, SNB-19 cells, SK-OV3 cells, H1993 lung cancer cells, 11358 lung cancer cells, PC-9 lung cancer cells, KHM-35 lung cancer cells, Capan-1 pancreatic cancer cells, HPAF-11 pancreatic cancer cells, and Colo 201 colorectal cancer cells.

In free uptake assays, antisense oligonucleotides are administered to cells lines without the aid of a transfection agent or electroporation. Antisense oligonucleotides are administered to cell lines at one or more doses and percent inhibition of target mRNA or protein expression is measured. Where multiple doses are administered, IC50 may be measured. In certain embodiments, antisense oligonucleotides exhibiting a high degree of potency, as measured by percent inhibition after single dose or multiple doses, are preferred over antisense oligonucleotides exhibiting a lower degree of potency. Those antisense oligonucleotides exhibiting a high degree of in vitro potency are more likely to exhibit in vivo potency.

RNA Isolation

RNA analysis can be performed on total cellular RNA or poly(A)+ mRNA. Methods of RNA isolation are well known in the art. RNA is prepared using methods well known in the art, for example, using the TRIZOL Reagent (Invitrogen, Carlsbad, Calif.) according to the manufacturer's recommended protocols.

Analysis of Inhibition of Target Levels or Expression

Inhibition of levels or expression of a STAT3 nucleic acid can be assayed in a variety of ways known in the art. For example, target nucleic acid levels can be quantitated by, e.g., Northern blot analysis, competitive polymerase chain reaction (PCR), or quantitative real-time PCR. RNA analysis can be performed on total cellular RNA or poly(A)+ mRNA. Methods of RNA isolation are well known in the art. Northern blot analysis is also routine in the art. Quantitative real-time PCR can be conveniently accomplished using the commercially available ABI PRISM 7600, 7700, or 7900 Sequence Detection System, available from PE-Applied Biosystems, Foster City, Calif. and used according to manufacturer's instructions.

Quantitative Real-Time PCR Analysis of Target RNA Levels

Quantitation of target RNA levels may be accomplished by quantitative real-time PCR using the ABI PRISM 7600, 7700, or 7900 Sequence Detection System (PE-Applied Biosystems, Foster City, Calif.) according to manufacturer's instructions. Methods of quantitative real-time PCR are well known in the art.

Prior to real-time PCR, the isolated RNA is subjected to a reverse transcriptase (RT) reaction, which produces complementary DNA (cDNA) that is then used as the substrate for the real-time PCR amplification. The RT and real-time PCR reactions are performed sequentially in the same sample well. RT and real-time PCR reagents may be obtained from Invitrogen (Carlsbad, Calif.). RT real-time-PCR reactions are carried out by methods well known to those skilled in the art.

Gene (or RNA) target quantities obtained by real time PCR are normalized using either the expression level of a gene whose expression is constant, such as cyclophilin A, or by quantifying total RNA using RIBOGREEN (Invitrogen, Inc. Carlsbad, Calif.). Cyclophilin A expression is quantified by real time PCR, by being run simultaneously with the target, multiplexing, or separately. Total RNA is quantified using RIBOGREEN RNA quantification reagent (Invetrogen, Inc. Eugene, Oreg.). Methods of RNA quantification by RIBOGREEN are taught in Jones, L. J., et al, (Analytical Biochemistry, 1998, 265, 368-374). A CYTOFLUOR 4000 instrument (PE Applied Biosystems) is used to measure RIBOGREEN fluorescence.

Probes and primers are designed to hybridize to a STAT3 nucleic acid. Methods for designing real-time PCR probes and primers are well known in the art, and may include the use of software such as PRIMER EXPRESS Software (Applied Biosystems, Foster City, Calif.).

Analysis of Protein Levels

Antisense inhibition of STAT3 nucleic acids can be assessed by measuring STAT3 protein levels. Protein levels of STAT3 can be evaluated or quantitated in a variety of ways well known in the art, such as immunoprecipitation, Western blot analysis (immunoblotting), enzyme-linked immunosorbent assay (ELISA), quantitative protein assays, protein activity assays (for example, caspase activity assays), immunohistochemistry, immunocytochemistry or fluorescence-activated cell sorting (FACS). Antibodies directed to a target can be identified and obtained from a variety of sources, such as the MSRS catalog of antibodies (Aerie Corporation, Birmingham, Mich.), or can be prepared via conventional monoclonal or polyclonal antibody generation methods well known in the art. Antibodies useful for the detection of mouse, rat, monkey, and human STAT3 are commercially available.

In Vivo Testing of Antisense Compounds

Antisense compounds, for example, antisense oligonucleotides, are tested in animals to assess their ability to inhibit expression of STAT3 and produce phenotypic changes, such as, reduced cellular growth, amelioration of symptoms associated with cancer, reduction of cachexia, and reduction of cancer markers. Testing may be performed in normal animals, or in experimental disease models. For administration to animals, antisense oligonucleotides are formulated in a pharmaceutically acceptable diluent, such as phosphate-buffered saline. Administration includes parenteral routes of administration, such as intraperitoneal, intravenous, subcutaneous, intrathecal, and intracerebroventricular. Calculation of antisense oligonucleotide dosage and dosing frequency is within the abilities of those skilled in the art, and depends upon factors such as route of administration and animal body weight. Following a period of treatment with antisense oligonucleotides, RNA is isolated from liver tissue and changes in STAT3 nucleic acid expression are measured. Changes in STAT3 protein levels are also measured.

In certain embodiments, xenograft tumor models are used to measure the effect of antisense oligonucleotides on tumor growth and metastasis. In xenograft tumor model described herein, cells from a cancerous cell line are inoculated into an animal. Such cell lines may include, for example, human breast cancer cells, MDA-MB-231, A431 human epidermoid carcinoma, U251 human glioma tumor cells, and human NCI-H460 non-small cell lung carcinoma cells. Certain compounds described herein and used in xenograft models described herein may target human STAT3, mouse STAT3, rat STAT3, and/or monkey STAT3. Certain compounds described herein and used in xenograft models described herein may cross-react with one or more species STAT3. In certain embodiments, compounds described herein and used in xenograft models described herein may be more potent inhibitors of tumor growth and tumor volume than the data suggests wherein endogenous STAT3 is not reduced (due to lack of cross-reactivity).

Certain Indications

In certain embodiments, provided are methods, compounds, and compositions of treating an individual comprising administering one or more pharmaceutical compositions provided herein. In certain embodiments, the individual has a hyperproliferative disease. In certain embodiments, the hyperproliferative disease is cancer, e.g., carcinomas, sarcomas, lymphomas, and leukemias as well as associated malignancies and metastases. In certain embodiments, the type of cancer is lung cancer, including non small cell lung cancer (NSCLC), pancreatic cancer, colorectal cancer, multiple myeloma, hepatocellular carcinoma (HCC), glioblastoma, ovarian cancer, osteosarcoma, head and neck cancer, breast cancer, epidermoid carcinomas, intestinal adenomas, prostate cancer, and gastric cancer. In certain embodiments, the individual is at risk for a hyperproliferative disease, including, cancer, e.g., carcinomas, sarcomas, lymphomas, and leukemias as well as associated malignancies and metastases. This includes individuals having one or more risk factors for developing a hyperproliferative disease, including, growing older; tobacco use; exposure to sunlight and ionizing radiation; contact with certain chemicals; infection with certain viruses and bacteria; certain hormone therapies; genetic predisposition; alcohol use; and certain lifestyle choices including poor diet, lack of physical activity, and/or being overweight. In certain embodiments, the individual has been identified as in need of treatment for a hyperproliferative disease. In certain embodiments, are provided methods for prophylactically reducing STAT3 expression in an individual. Certain embodiments include treating an individual in need thereof by administering to an individual a therapeutically effective amount of an antisense compound targeted to a STAT3 nucleic acid.

In certain embodiments, treatment with the methods, compounds, and compositions described herein is useful for preventing metastasis of a cancer associated with the upregulation of certain genes, such as STAT3, at the tumor bone interface to bone. In certain embodiments, treatment with the methods, compounds, and compositions described herein is useful for preventing cancer from metastasizing to bone. In certain embodiments, treatment with the methods, compounds, and compositions described herein is useful for preventing renal cell carcinoma, breast cancer, non small cell lung carcinoma, and prostate cancer from metastasizing to bone.

In one embodiment, administration of a therapeutically effective amount of an antisense compound targeted to a STAT3 nucleic acid is accompanied by monitoring of STAT3 levels in the serum of an individual to determine an individual's response to administration of the antisense compound. An individual's response to administration of the antisense compound is used by a physician to determine the amount and duration of therapeutic intervention.

In certain embodiments, administration of an antisense compound targeted to a STAT3 nucleic acid results in reduction of STAT3 expression by at least 15, 20, 25, 30, 35, 40, 45, 50, 55, 60, 65, 70, 75, 80, 85, 90, 95 or 99%, or a range defined by any two of these values. In certain embodiments, administration of an antisense compound targeted to a STAT3 nucleic acid results in reduced cellular growth, reduced tumor growth, reduced tumor volume, amelioration of symptoms associated with cancer, and reduction of cancer markers. In certain embodiments, administration of a STAT3 antisense compound decreases cellular growth, tumor growth, and tumor volume by at least 15, 20, 25, 30, 35, 40, 45, 50, 55, 60, 65, 70, 75, 80, 85, 90, 95 or 99%, or a range defined by any two of these values.

In certain embodiments, pharmaceutical compositions comprising an antisense compound targeted to STAT3 are used for the preparation of a medicament for treating a patient suffering or susceptible to a hyperproliferative disease.

Certain Combination Therapies

In certain embodiments, one or more pharmaceutical compositions provided herein are co-administered with one or more other pharmaceutical agents. In certain embodiments, such one or more other pharmaceutical agents are designed to treat the same disease, disorder, or condition as the one or more pharmaceutical compositions provided herein. In certain embodiments, such one or more other pharmaceutical agents are designed to treat a different disease, disorder, or condition as the one or more pharmaceutical compositions provided herein. In certain embodiments, such one or more other pharmaceutical agents are designed to treat an undesired side effect of one or more pharmaceutical compositions provided herein. In certain embodiments, one or more pharmaceutical compositions provided herein are co-administered with another pharmaceutical agent to treat an undesired effect of that other pharmaceutical agent. In certain embodiments, one or more pharmaceutical compositions provided herein are co-administered with another pharmaceutical agent to produce a combinational effect. In certain embodiments, one or more pharmaceutical compositions provided herein are co-administered with another pharmaceutical agent to produce a synergistic effect.

In certain embodiments, one or more pharmaceutical compositions provided herein and one or more other pharmaceutical agents are administered at the same time. In certain embodiments, one or more pharmaceutical compositions provided herein and one or more other pharmaceutical agents are administered at different times. In certain embodiments, one or more pharmaceutical compositions provided herein and one or more other pharmaceutical agents are prepared together in a single formulation. In certain embodiments, one or more pharmaceutical compositions provided herein and one or more other pharmaceutical agents are prepared separately. In certain embodiments, one or more other pharmaceutical agents include all-trans retinoic acid, azacitidine, azathioprine, bleomycin, carboplatin, capecitabine, cisplatin, chlorambucil, cyclophosphamide, cytarabine, daunorubicin, docetaxel, doxifluridine, doxorubicin, epirubicin, epothilone, etoposide, fluorouracil, gemcitabine, hydroxyurea, idarubicin, imatinib, mechlorethamine, mercaptopurine, methotrexate, mitoxantrone, oxaliplatin, paclitaxel, pemetrexed, teniposide, tioguanine, valrubicin, vinblastine, vincristine, vindesine, or vinorelbine. In certain embodiments, one or more other pharmaceutical agents include another antisense oligonucleotide. In certain embodiments, another antisense oligonucleotide is a second STAT3 antisense oligonucleotide.

In certain embodiments, one or more other pharmaceutical agents include molecular targeted therapies. In certain embodiments, the molecular targeted therapy is an EGFR inhibitor, a mTOR inhibitor, a HER2 inhibitor, or a VEGFNEGFR inhibitor. In certain embodiments, EGFR inhibitors include gefitinib, erlotinib, lapatinib, cetuximab, panitumumbo. In certain embodiments, mTOR inhibitors include everolimus and temsirolimus. In certain embodiments, HER2 inhibitors include trastuzumab and lapatinib. In certain embodiments, VEGFNEGFR inhibitors include pazopanib, bevacizumab, sunitinib, and sorafenib.

In certain embodiments, one more pharmaceutical compositions provided herein are administered with radiation therapy. In certain embodiments, one or more pharmaceutical compositions are administered at the same time as radiation therapy. In certain embodiments, one or more pharmaceutical compositions are administered before radiation therapy. In certain embodiments, one or more pharmaceutical compositions are administered after radiation therapy. In certain embodiments, one or more pharmaceutical compositions are administered at various time points throughout a radiation therapy regimen.

In certain embodiments, radiation therapy is useful for inhibiting tumor growth. In certain embodiments, radiation therapy is useful for increasing overall survival. In certain embodiments, radiation therapy used in conjunction with administration of one or more pharmaceuticals provided herein is advantageous over using either therapy alone because both radiation therapy and administration with one or more pharmaceuticals can be limited to achieve effective antiproliferative response with limited toxicity.

In certain embodiments, a physician designs a therapy regimen including both radiation therapy and administration of one more pharmaceutical compositions provided herein. In certain embodiments, a physician designs a therapy regimen including radiation therapy, administration of one or more pharmaceutical compositions provided herein, and administration of one or more other chemotherapeutic agents.

Tolerability

In certain embodiments, the compounds provided herein display minimal side effects. Side effects include responses to the administration of the antisense compound that are typically unrelated to the targeting of STAT3, such as an inflammatory response in the animal. In certain embodiments compounds are well tolerated by the animal. Increased tolerability can depend on a number of factors, including, but not limited to, the nucleotide sequence of the antisense compound, chemical modifications to the nucleotides, the particular motif of unmodified and modified nucleosides in the antisense compound, or combinations thereof. Tolerability may be determined by a number of factors. Such factors include body weight, organ weight, liver function, kidney function, platelet count, white blood cell count.

In certain embodiments, the compounds provided herein demonstrate minimal effect on organ weight. In certain embodiments, the compounds demonstrate less than a 7-fold, 6-fold, 5-fold, 4-fold, 3-fold, 2-fold or no significant increase in spleen and/or liver weight.

In certain embodiments, the compounds provided herein demonstrate minimal effect on liver function. Factors for the evaluation of liver function include ALT levels, AST levels, plasma bilirubin levels and plasma albumin levels. In certain embodiments the compounds provided herein demonstrate less than a 7-fold, less than a 6-fold, less than a 5-fold, less than a 4-fold, less than a 3-fold or less than a 2-fold or no significant increase in ALT or AST. In certain embodiments the compounds provided herein demonstrate less than a 3-fold, less than a 2-fold or no significant increase in plasma bilirubin levels.

In certain embodiments, the compounds provided herein demonstrate minimal effect on kidney function. In certain embodiments, the compounds provided herein demonstrate less than a 3-fold, less than a 2-fold, or no significant increase in plasma concentrations of blood urea nitrogen (BUN). In certain embodiments, the compounds provided herein demonstrate less than a 6-fold, 5-fold, 4-fold, 3-fold, 2-fold, or no significant increase in the ratio of urine protein to creatinine.

In certain embodiments, the compounds provided herein demonstrate minimal effect on hematological factors. In certain embodiments, the compounds provided herein demonstrate less than a 60%, 50%, 40%, 30%, 20%, 10% or 5% decrease in platelet count. In certain embodiments, the compounds provided herein demonstrate less than a 4-fold, less than a 3-fold, less than a 2-fold or no significant increase in monocyte count.

In certain embodiments compounds further display favorable pharmacokinetics. In certain embodiments, antisense compounds exhibit relatively high half-lives in relevant biological fluids or tissues.

In certain embodiments, compounds or compositions further display favorable viscosity. In certain embodiments, the viscosity of the compound or composition is no more than 40cP at a concentration of 165-185 mg/mL.

In other embodiments, the compounds display combinations of the characteristics above and reduce STAT3 mRNA expression in an animal model with high efficiency.

EXAMPLES

Non-Limiting Disclosure and Incorporation by Reference

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1

Antisense Inhibition of Human STAT3 in HuVEC Cells

Antisense oligonucleotides were designed targeting a human STAT3 nucleic acid and were tested for their effect on human STAT3 mRNA expression in vitro. The chimeric antisense oligonucleotides presented in Tables 1 and 2 were designed as either 2-10-2 cEt gapmers or 3-10-3 cEt gapmers. The 2-10-2 cEt gapmers are 14 nucleotides in length, wherein the central gap segment comprises ten 2'-deoxynucleosides and is flanked on both sides (in the 5' and 3' directions) by wings comprising two nucleosides each. The 3-10-3 cEt gapmers are 16 nucleosides in length, wherein the central gap segment comprises ten 2'-deoxynucleosides and is flanked on both sides (in the 5' and 3' directions) by wings comprising three nucleosides each. Each nucleoside in the 5' wing segment and each nucleoside in the 3' wing segment has an cEt sugar modification. The internucleoside linkages throughout each gapmer are phosphorothioate (P=S) linkages. All cytosine residues throughout each gapmer are 5'-methylcytosines.

Potency of cEt gapmers was compared to ISIS 337332, ISIS 337333, and ISIS 345785, which are 5-10-5 MOE gapmers targeting human STAT3 and are further described in U.S. Pat. No. 7,307,069, incorporated herein by reference.

Cultured HuVEC cells at a density of 20,000 cells per well were transfected using electroporation with 1,000 nM antisense oligonucleotide. After a treatment period of approximately 24 hours, RNA was isolated from the cells and STAT3 mRNA levels were measured by quantitative real-time PCR. Human primer probe set RTS199 (forward sequence ACATGCCACTTTGGTGTTTCATAA, designated herein as SEQ ID NO: 6; reverse sequence TCTTCGTAGATTGTGCTGATAGAGAAC, designated herein as SEQ ID NO: 7; probe sequence CAGTATAGCCGCTTCCTGCAAGAGTCGAA, designated herein as SEQ ID NO: 8) was used to measure mRNA levels. STAT3 mRNA levels were adjusted according to total RNA content, as measured by RIBOGREEN®. Results are presented as percent inhibition of STAT3, relative to untreated control cells. All cEt gapmers and MOE gapmers were tested under the same conditions.

"Human Target start site" indicates the 5'-most nucleotide to which the gapmer is targeted in the human gene sequence. "Human Target stop site" indicates the 3'-most nucleotide to which the gapmer is targeted human gene sequence. Each gapmer listed in Table 1 is targeted to human STAT3 mRNA, designated herein as SEQ ID NO: 1 (GENBANK Accession No. NM_139276.2). Each gapmer listed in Table 2 is targeted to the human STAT3 genomic sequence, designated herein as SEQ ID NO: 2 (the complement of GENBANK Accession No. NT_010755.14 truncated from nucleotides 4185000 to 4264000).

TABLE 1

Inhibition of human STAT3 mRNA levels by cEt and MOE chimeric antisense oligonucleotides targeted to SEQ ID NO: 1

| ISIS NO | Human Start Site | Human Stop Site | Sequence | Motif | Wing Chem | % inhibition | SEQ ID NO |
|---|---|---|---|---|---|---|---|
| 481350 | 76 | 91 | TCCAGGATCCGGTTGG | 3-10-3 | cEt | 52 | 9 |
| 481575 | 77 | 90 | CCAGGATCCGGTTG | 2-10-2 | cEt | 41 | 10 |
| 481351 | 132 | 147 | GGCCGAAGGGCCTCTC | 3-10-3 | cEt | 14 | 11 |
| 481576 | 133 | 146 | GCCGAAGGGCCTCT | 2-10-2 | cEt | 8 | 12 |
| 481352 | 225 | 240 | CCTGCTAAAATCAGGG | 3-10-3 | cEt | 15 | 13 |
| 481577 | 226 | 239 | CTGCTAAAATCAGG | 2-10-2 | cEt | 12 | 14 |
| 481353 | 240 | 255 | ATTCCATTGGGCCATC | 3-10-3 | cEt | 78 | 15 |
| 481578 | 241 | 254 | TTCCATTGGGCCAT | 2-10-2 | cEt | 51 | 16 |
| 481354 | 264 | 279 | CCGTGTGTCAAGCTGC | 3-10-3 | cEt | 98 | 17 |
| 481579 | 265 | 278 | CGTGTGTCAAGCTG | 2-10-2 | cEt | 91 | 18 |
| 481355 | 322 | 337 | ACTGCCGCAGCTCCAT | 3-10-3 | cEt | 95 | 19 |
| 481580 | 323 | 336 | CTGCCGCAGCTCCA | 2-10-2 | cEt | 76 | 20 |
| 481356 | 346 | 361 | GACTCTCAATCCAAGG | 3-10-3 | cEt | 83 | 21 |
| 481581 | 347 | 360 | ACTCTCAATCCAAG | 2-10-2 | cEt | 31 | 22 |
| 481357 | 375 | 390 | TTCTTTGCTGGCCGCA | 3-10-3 | cEt | 97 | 23 |
| 481582 | 376 | 389 | TCTTTGCTGGCCGC | 2-10-2 | cEt | 87 | 24 |
| 481358 | 403 | 418 | GATTATGAAACACCAA | 3-10-3 | cEt | 85 | 25 |
| 481583 | 404 | 417 | ATTATGAAACACCA | 2-10-2 | cEt | 20 | 26 |
| 481359 | 429 | 444 | ATACTGCTGGTCAATC | 3-10-3 | cEt | 90 | 27 |
| 481584 | 430 | 443 | TACTGCTGGTCAAT | 2-10-2 | cEt | 42 | 28 |
| 481360 | 459 | 474 | GAGAACATTCGACTCT | 3-10-3 | cEt | 75 | 29 |
| 481585 | 460 | 473 | AGAACATTCGACTC | 2-10-2 | cEt | 77 | 30 |
| 481361 | 474 | 489 | TAGATTGTGCTGATAG | 3-10-3 | cEt | 90 | 31 |
| 481586 | 475 | 488 | AGATTGTGCTGATA | 2-10-2 | cEt | 81 | 32 |
| 481362 | 490 | 505 | ACTGCTTGATTCTTCG | 3-10-3 | cEt | 59 | 33 |
| 481587 | 491 | 504 | CTGCTTGATTCTTC | 2-10-2 | cEt | 23 | 34 |
| 481363 | 511 | 526 | CAAGATACCTGCTCTG | 3-10-3 | cEt | 84 | 35 |
| 481588 | 512 | 525 | AAGATACCTGCTCT | 2-10-2 | cEt | 58 | 36 |
| 481364 | 542 | 557 | GCCACAATCCGGGCAA | 3-10-3 | cEt | 36 | 37 |
| 481589 | 543 | 556 | CCACAATCCGGGCA | 2-10-2 | cEt | 69 | 38 |
| 481365 | 589 | 604 | CAGTGGCTGCAGTCTG | 3-10-3 | cEt | 36 | 39 |

TABLE 1-continued

Inhibition of human STAT3 mRNA levels by cEt and MOE chimeric antisense oligonucleotides targeted to SEQ ID NO: 1

| ISIS NO | Human Start Site | Human Stop Site | Sequence | Motif | Wing Chem | % inhibition | SEQ ID NO |
|---|---|---|---|---|---|---|---|
| 481590 | 590 | 603 | AGTGGCTGCAGTCT | 2-10-2 | cEt | 30 | 40 |
| 481366 | 607 | 622 | GGCCCCCTTGCTGGGC | 3-10-3 | cEt | 1 | 41 |
| 481591 | 608 | 621 | GCCCCCTTGCTGGG | 2-10-2 | cEt | 0 | 42 |
| 481367 | 638 | 653 | GTCACCACGGCTGCTG | 3-10-3 | cEt | 70 | 43 |
| 481592 | 639 | 652 | TCACCACGGCTGCT | 2-10-2 | cEt | 48 | 44 |
| 481368 | 659 | 674 | TCCAGCATCTGCTGCT | 3-10-3 | cEt | 81 | 45 |
| 481593 | 660 | 673 | CCAGCATCTGCTGC | 2-10-2 | cEt | 46 | 46 |
| 481369 | 675 | 690 | ATCCTGAAGGTGCTGC | 3-10-3 | cEt | 29 | 47 |
| 481594 | 676 | 689 | TCCTGAAGGTGCTG | 2-10-2 | cEt | 16 | 48 |
| 481370 | 701 | 716 | TCTAGATCCTGCACTC | 3-10-3 | cEt | 79 | 49 |
| 481595 | 702 | 715 | CTAGATCCTGCACT | 2-10-2 | cEt | 47 | 50 |
| 481371 | 709 | 724 | TTTTCTGTTCTAGATC | 3-10-3 | cEt | 83 | 51 |
| 481596 | 710 | 723 | TTTCTGTTCTAGAT | 2-10-2 | cEt | 48 | 52 |
| 481372 | 730 | 745 | GGAGATTCTCTACCAC | 3-10-3 | cEt | 85 | 53 |
| 481597 | 731 | 744 | GAGATTCTCTACCA | 2-10-2 | cEt | 80 | 54 |
| 481373 | 751 | 766 | AGTTGAAATCAAAGTC | 3-10-3 | cEt | 87 | 55 |
| 481598 | 752 | 765 | GTTGAAATCAAAGT | 2-10-2 | cEt | 6 | 56 |
| 481374 | 788 | 803 | AGATCTTGCATGTCTC | 3-10-3 | cEt | 92 | 57 |
| 481599 | 789 | 802 | GATCTTGCATGTCT | 2-10-2 | cEt | 51 | 58 |
| 481375 | 799 | 814 | TGTTTCCATTCAGATC | 3-10-3 | cEt | 65 | 59 |
| 481600 | 800 | 813 | GTTTCCATTCAGAT | 2-10-2 | cEt | 42 | 60 |
| 481376 | 868 | 883 | TCCGCATCTGGTCCAG | 3-10-3 | cEt | 82 | 61 |
| 481601 | 869 | 882 | CCGCATCTGGTCCA | 2-10-2 | cEt | 70 | 62 |
| 481785 | 872 | 885 | TCTCCGCATCTGGT | 2-10-2 | cEt | 28 | 63 |
| 481377 | 884 | 899 | TCACTCACGATGCTTC | 3-10-3 | cEt | 85 | 64 |
| 481602 | 885 | 898 | CACTCACGATGCTT | 2-10-2 | cEt | 55 | 65 |
| 481378 | 892 | 907 | CCGCCAGCTCACTCAC | 3-10-3 | cEt | 89 | 66 |
| 481603 | 893 | 906 | CGCCAGCTCACTCA | 2-10-2 | cEt | 60 | 67 |
| 481379 | 955 | 970 | TCCAGTCAGCCAGCTC | 3-10-3 | cEt | 91 | 68 |
| 481604 | 956 | 969 | CCAGTCAGCCAGCT | 2-10-2 | cEt | 70 | 69 |
| 481380 | 963 | 978 | CCGCCTCTTCCAGTCA | 3-10-3 | cEt | 73 | 70 |
| 481605 | 964 | 977 | CGCCTCTTCCAGTC | 2-10-2 | cEt | 55 | 71 |
| 481381 | 1010 | 1025 | CGATCTAGGCAGATGT | 3-10-3 | cEt | 26 | 72 |
| 481606 | 1011 | 1024 | GATCTAGGCAGATG | 2-10-2 | cEt | 35 | 73 |
| 481382 | 1045 | 1060 | GAGATTCTGCTAATGA | 3-10-3 | cEt | 81 | 74 |
| 481607 | 1046 | 1059 | AGATTCTGCTAATG | 2-10-2 | cEt | 51 | 75 |
| 481383 | 1053 | 1068 | CTGAAGTTGAGATTCT | 3-10-3 | cEt | 84 | 76 |

TABLE 1-continued

Inhibition of human STAT3 mRNA levels by cEt and MOE chimeric antisense oligonucleotides targeted to SEQ ID NO: 1

| ISIS NO | Human Start Site | Human Stop Site | Sequence | Motif | Wing Chem | % inhibition | SEQ ID NO |
|---|---|---|---|---|---|---|---|
| 481608 | 1054 | 1067 | TGAAGTTGAGATTC | 2-10-2 | cEt | 26 | 77 |
| 481384 | 1098 | 1113 | AACTTTTTGCTGCAAC | 3-10-3 | cEt | 76 | 78 |
| 481609 | 1099 | 1112 | ACTTTTTGCTGCAA | 2-10-2 | cEt | 34 | 79 |
| 481385 | 1113 | 1128 | GTCCCCTTTGTAGGAA | 3-10-3 | cEt | 41 | 80 |
| 481610 | 1114 | 1127 | TCCCCTTTGTAGGA | 2-10-2 | cEt | 37 | 81 |
| 481386 | 1186 | 1201 | AGGCACTTTTCATTAA | 3-10-3 | cEt | 45 | 82 |
| 481611 | 1187 | 1200 | GGCACTTTTCATTA | 2-10-2 | cEt | 32 | 83 |
| 481387 | 1225 | 1240 | CAGGATGCATGGGCAT | 3-10-3 | cEt | 92 | 84 |
| 481612 | 1226 | 1239 | AGGATGCATGGGCA | 2-10-2 | cEt | 86 | 85 |
| 481388 | 1269 | 1284 | TTTAGTAGTGAACTGG | 3-10-3 | cEt | 74 | 86 |
| 481613 | 1270 | 1283 | TTAGTAGTGAACTG | 2-10-2 | cEt | 22 | 87 |
| 481389 | 1282 | 1297 | CCAGCAACCTGACTTT | 3-10-3 | cEt | 66 | 88 |
| 481614 | 1283 | 1296 | CAGCAACCTGACTT | 2-10-2 | cEt | 34 | 89 |
| 481390 | 1305 | 1320 | ATAATTCAACTCAGGG | 3-10-3 | cEt | 92 | 90 |
| 481615 | 1306 | 1319 | TAATTCAACTCAGG | 2-10-2 | cEt | 48 | 91 |
| 481391 | 1314 | 1329 | TTTAAGCTGATAATTC | 3-10-3 | cEt | 44 | 92 |
| 481616 | 1315 | 1328 | TTAAGCTGATAATT | 2-10-2 | cEt | 0 | 93 |
| 481392 | 1326 | 1341 | GCACACTTTAATTTTA | 3-10-3 | cEt | 49 | 94 |
| 481617 | 1327 | 1340 | CACACTTTAATTTT | 2-10-2 | cEt | 1 | 95 |
| 481393 | 1347 | 1362 | GTCCCCAGAGTCTTTG | 3-10-3 | cEt | 39 | 96 |
| 481618 | 1348 | 1361 | TCCCCAGAGTCTTT | 2-10-2 | cEt | 41 | 97 |
| 481394 | 1437 | 1452 | GAGGCTGCCGTTGTTG | 3-10-3 | cEt | 62 | 98 |
| 481619 | 1438 | 1451 | AGGCTGCCGTTGTT | 2-10-2 | cEt | 29 | 99 |
| 481395 | 1468 | 1483 | CCCTCAGGGTCAAGTG | 3-10-3 | cEt | 72 | 100 |
| 481620 | 1469 | 1482 | CCTCAGGGTCAAGT | 2-10-2 | cEt | 37 | 101 |
| 481396 | 1480 | 1495 | CACATCTCTGCTCCCT | 3-10-3 | cEt | 92 | 102 |
| 481621 | 1481 | 1494 | ACATCTCTGCTCCC | 2-10-2 | cEt | 74 | 103 |
| 481397 | 1517 | 1532 | ATCAGGGAAGCATCAC | 3-10-3 | cEt | 59 | 104 |
| 481622 | 1518 | 1531 | TCAGGGAAGCATCA | 2-10-2 | cEt | 49 | 105 |
| 481398 | 1542 | 1557 | GATCAGGTGCAGCTCC | 3-10-3 | cEt | 73 | 106 |
| 481623 | 1543 | 1556 | ATCAGGTGCAGCTC | 2-10-2 | cEt | 40 | 107 |
| 481399 | 1563 | 1578 | ATACACCTCGGTCTCA | 3-10-3 | cEt | 73 | 108 |
| 481624 | 1564 | 1577 | TACACCTCGGTCTC | 2-10-2 | cEt | 43 | 109 |
| 481400 | 1579 | 1594 | TCTTGAGGCCTTGGTG | 3-10-3 | cEt | 47 | 110 |
| 481625 | 1580 | 1593 | CTTGAGGCCTTGGT | 2-10-2 | cEt | 16 | 111 |
| 481401 | 1589 | 1604 | TCTAGGTCAATCTTGA | 3-10-3 | cEt | 74 | 112 |

TABLE 1-continued

Inhibition of human STAT3 mRNA levels by cEt and MOE chimeric antisense oligonucleotides targeted to SEQ ID NO: 1

| ISIS NO | Human Start Site | Human Stop Site | Sequence | Motif | Wing Chem | % inhibition | SEQ ID NO |
|---|---|---|---|---|---|---|---|
| 481626 | 1590 | 1603 | CTAGGTCAATCTTG | 2-10-2 | cEt | 54 | 113 |
| 481402 | 1599 | 1614 | GGAGTGGGTCTCTAGG | 3-10-3 | cEt | 52 | 114 |
| 481627 | 1600 | 1613 | GAGTGGGTCTCTAG | 2-10-2 | cEt | 13 | 115 |
| 481789 | 1604 | 1617 | CAAGGAGTGGGTCT | 2-10-2 | cEt | 10 | 116 |
| 481403 | 1607 | 1622 | ACTGGCAAGGAGTGGG | 3-10-3 | cEt | 58 | 117 |
| 481628 | 1608 | 1621 | CTGGCAAGGAGTGG | 2-10-2 | cEt | 38 | 118 |
| 481404 | 1633 | 1648 | TCTGACAGATGTTGGA | 3-10-3 | cEt | 50 | 119 |
| 481629 | 1634 | 1647 | CTGACAGATGTTGG | 2-10-2 | cEt | 64 | 120 |
| 481405 | 1641 | 1656 | ATTTGGCATCTGACAG | 3-10-3 | cEt | 75 | 121 |
| 481630 | 1642 | 1655 | TTTGGCATCTGACA | 2-10-2 | cEt | 39 | 122 |
| 481406 | 1691 | 1706 | TTCTTGGGATTGTTGG | 3-10-3 | cEt | 72 | 123 |
| 481631 | 1692 | 1705 | TCTTGGGATTGTTG | 2-10-2 | cEt | 33 | 124 |
| 481407 | 1729 | 1744 | CCCAGGTTCCAATTGG | 3-10-3 | cEt | 50 | 125 |
| 481632 | 1730 | 1743 | CCAGGTTCCAATTG | 2-10-2 | cEt | 32 | 126 |
| 481408 | 1780 | 1795 | CTCGCTTGGTGGTGGA | 3-10-3 | cEt | 53 | 127 |
| 481633 | 1781 | 1794 | TCGCTTGGTGGTGG | 2-10-2 | cEt | 35 | 128 |
| 481409 | 1795 | 1810 | GCTCGATGCTCAGTCC | 3-10-3 | cEt | 86 | 129 |
| 481634 | 1796 | 1809 | CTCGATGCTCAGTC | 2-10-2 | cEt | 43 | 130 |
| 481410 | 1825 | 1840 | CCAAGAGTTTCTCTGC | 3-10-3 | cEt | 91 | 131 |
| 481635 | 1826 | 1839 | CAAGAGTTTCTCTG | 2-10-2 | cEt | 43 | 132 |
| 481411 | 1840 | 1855 | AATTCACACCAGGTCC | 3-10-3 | cEt | 72 | 133 |
| 481636 | 1841 | 1854 | ATTCACACCAGGTC | 2-10-2 | cEt | 42 | 134 |
| 481412 | 1858 | 1873 | TGATCTGACACCCTGA | 3-10-3 | cEt | 90 | 135 |
| 481637 | 1859 | 1872 | GATCTGACACCCTG | 2-10-2 | cEt | 79 | 136 |
| 481413 | 1866 | 1881 | AGCCCATGTGATCTGA | 3-10-3 | cEt | 80 | 137 |
| 481638 | 1867 | 1880 | GCCCATGTGATCTG | 2-10-2 | cEt | 64 | 138 |
| 481414 | 1888 | 1903 | CCATGTTTTCTTTGCA | 3-10-3 | cEt | 69 | 139 |
| 481639 | 1889 | 1902 | CATGTTTTCTTTGC | 2-10-2 | cEt | 16 | 140 |
| 481415 | 1896 | 1911 | CTTGCCAGCCATGTTT | 3-10-3 | cEt | 88 | 141 |
| 481640 | 1897 | 1910 | TTGCCAGCCATGTT | 2-10-2 | cEt | 57 | 142 |
| 337332 | 1898 | 1917 | GAAGCCCTTGCCAGCCATGT | 5-10-5 | MOE | 63 | 143 |
| 481416 | 1901 | 1916 | AAGCCCTTGCCAGCCA | 3-10-3 | cEt | 87 | 144 |
| 481641 | 1902 | 1915 | AGCCCTTGCCAGCC | 2-10-2 | cEt | 68 | 145 |
| 337333 | 1903 | 1922 | AAGGAGAAGCCCTTGCCAGC | 5-10-5 | MOE | 49 | 146 |
| 481417 | 1903 | 1918 | AGAAGCCCTTGCCAGC | 3-10-3 | cEt | 97 | 147 |
| 481418 | 1904 | 1919 | GAGAAGCCCTTGCCAG | 3-10-3 | cEt | 92 | 148 |
| 481642 | 1904 | 1917 | GAAGCCCTTGCCAG | 2-10-2 | cEt | 67 | 149 |

TABLE 1-continued

Inhibition of human STAT3 mRNA levels by cEt and MOE chimeric antisense oligonucleotides targeted to SEQ ID NO: 1

| ISIS NO | Human Start Site | Human Stop Site | Sequence | Motif | Wing Chem | % inhibition | SEQ ID NO |
|---|---|---|---|---|---|---|---|
| 481419 | 1905 | 1920 | GGAGAAGCCCTTGCCA | 3-10-3 | cEt | 83 | 150 |
| 481643 | 1905 | 1918 | AGAAGCCCTTGCCA | 2-10-2 | cEt | 58 | 151 |
| 481644 | 1906 | 1919 | GAGAAGCCCTTGCC | 2-10-2 | cEt | 45 | 152 |
| 481420 | 1948 | 1963 | ACTTTTTCACAAGGTC | 3-10-3 | cEt | 94 | 153 |
| 481645 | 1949 | 1962 | CTTTTTCACAAGGT | 2-10-2 | cEt | 50 | 154 |
| 481421 | 2021 | 2036 | CTCAAGATGGCCCGCT | 3-10-3 | cEt | 86 | 155 |
| 481646 | 2022 | 2035 | TCAAGATGGCCCGC | 2-10-2 | cEt | 41 | 156 |
| 481422 | 2036 | 2051 | CCTGGAGGCTTAGTGC | 3-10-3 | cEt | 80 | 157 |
| 481647 | 2037 | 2050 | CTGGAGGCTTAGTG | 2-10-2 | cEt | 0 | 158 |
| 481423 | 2077 | 2092 | CTCCTTCTTTGCTGCT | 3-10-3 | cEt | 69 | 159 |
| 481648 | 2078 | 2091 | TCCTTCTTTGCTGC | 2-10-2 | cEt | 51 | 160 |
| 481424 | 2093 | 2108 | CAAGTGAAAGTGACGC | 3-10-3 | cEt | 70 | 161 |
| 481649 | 2094 | 2107 | AAGTGAAAGTGACG | 2-10-2 | cEt | 25 | 162 |
| 481425 | 2115 | 2130 | ACCGCTGATGTCCTTC | 3-10-3 | cEt | 78 | 163 |
| 481650 | 2116 | 2129 | CCGCTGATGTCCTT | 2-10-2 | cEt | 79 | 164 |
| 481426 | 2131 | 2146 | ACTGGATCTGGGTCTT | 3-10-3 | cEt | 80 | 165 |
| 481651 | 2132 | 2145 | CTGGATCTGGGTCT | 2-10-2 | cEt | 64 | 166 |
| 481427 | 2155 | 2170 | GCTGCTTTGTGTATGG | 3-10-3 | cEt | 75 | 167 |
| 481652 | 2156 | 2169 | CTGCTTTGTGTATG | 2-10-2 | cEt | 82 | 168 |
| 481428 | 2164 | 2179 | TGTTCAGCTGCTGCTT | 3-10-3 | cEt | 77 | 169 |
| 481653 | 2165 | 2178 | GTTCAGCTGCTGCT | 2-10-2 | cEt | 79 | 170 |
| 481429 | 2172 | 2187 | TGACATGTTGTTCAGC | 3-10-3 | cEt | 84 | 171 |
| 481654 | 2173 | 2186 | GACATGTTGTTCAG | 2-10-2 | cEt | 70 | 172 |
| 481430 | 2190 | 2205 | CATGATGATTTCAGCA | 3-10-3 | cEt | 67 | 173 |
| 481655 | 2191 | 2204 | ATGATGATTTCAGC | 2-10-2 | cEt | 31 | 174 |
| 481431 | 2206 | 2221 | CCATGATCTTATAGCC | 3-10-3 | cEt | 91 | 175 |
| 481656 | 2207 | 2220 | CATGATCTTATAGC | 2-10-2 | cEt | 0 | 176 |
| 481432 | 2233 | 2248 | GTGGAGACACCAGGAT | 3-10-3 | cEt | 55 | 177 |
| 481657 | 2234 | 2247 | TGGAGACACCAGGA | 2-10-2 | cEt | 58 | 178 |
| 481433 | 2256 | 2271 | AATGTCAGGATAGAGA | 3-10-3 | cEt | 73 | 179 |
| 481658 | 2257 | 2270 | ATGTCAGGATAGAG | 2-10-2 | cEt | 62 | 180 |
| 481434 | 2266 | 2281 | CCTCCTTGGGAATGTC | 3-10-3 | cEt | 73 | 181 |
| 345785 | 2267 | 2286 | TGCCTCCTCCTTGGGAATGT | 5-10-5 | MOE | 50 | 182 |
| 481659 | 2267 | 2280 | CTCCTTGGGAATGT | 2-10-2 | cEt | 51 | 183 |
| 481435 | 2269 | 2284 | CCTCCTCCTTGGGAAT | 3-10-3 | cEt | 49 | 184 |
| 481660 | 2270 | 2283 | CTCCTCCTTGGGAA | 2-10-2 | cEt | 54 | 185 |

TABLE 1-continued

Inhibition of human STAT3 mRNA levels by cEt and MOE chimeric antisense oligonucleotides targeted to SEQ ID NO: 1

| ISIS NO | Human Start Site | Human Stop Site | Sequence | Motif | Wing Chem | % inhibition | SEQ ID NO |
|---|---|---|---|---|---|---|---|
| 481436 | 2275 | 2290 | CGAATGCCTCCTCCTT | 3-10-3 | cEt | 82 | 186 |
| 481661 | 2276 | 2289 | GAATGCCTCCTCCT | 2-10-2 | cEt | 76 | 187 |
| 481437 | 2296 | 2311 | TCTCTGGCCGACAATA | 3-10-3 | cEt | 49 | 188 |
| 481662 | 2297 | 2310 | CTCTGGCCGACAAT | 2-10-2 | cEt | 43 | 189 |
| 481438 | 2353 | 2368 | ACTTGGTCTTCAGGTA | 3-10-3 | cEt | 51 | 190 |
| 481663 | 2354 | 2367 | CTTGGTCTTCAGGT | 2-10-2 | cEt | 52 | 191 |
| 481439 | 2371 | 2386 | TTGGTGTCACACAGAT | 3-10-3 | cEt | 82 | 192 |
| 481664 | 2372 | 2385 | TGGTGTCACACAGA | 2-10-2 | cEt | 89 | 193 |
| 481440 | 2387 | 2402 | GTATTGCTGCAGGTCG | 3-10-3 | cEt | 79 | 194 |
| 481665 | 2388 | 2401 | TATTGCTGCAGGTC | 2-10-2 | cEt | 43 | 195 |
| 481441 | 2395 | 2410 | GGTCAATGGTATTGCT | 3-10-3 | cEt | 55 | 196 |
| 481666 | 2396 | 2409 | GTCAATGGTATTGC | 2-10-2 | cEt | 36 | 197 |
| 481442 | 2403 | 2418 | CATCGGCAGGTCAATG | 3-10-3 | cEt | 44 | 198 |
| 481667 | 2404 | 2417 | ATCGGCAGGTCAAT | 2-10-2 | cEt | 31 | 199 |
| 481443 | 2423 | 2438 | GAATCTAAAGTGCGGG | 3-10-3 | cEt | 78 | 200 |
| 481668 | 2424 | 2437 | AATCTAAAGTGCGG | 2-10-2 | cEt | 41 | 201 |
| 481444 | 2431 | 2446 | GCATCAATGAATCTAA | 3-10-3 | cEt | 66 | 202 |
| 481669 | 2432 | 2445 | CATCAATGAATCTA | 2-10-2 | cEt | 0 | 203 |
| 481445 | 2439 | 2454 | TCCAAACTGCATCAAT | 3-10-3 | cEt | 70 | 204 |
| 481670 | 2440 | 2453 | CCAAACTGCATCAA | 2-10-2 | cEt | 60 | 205 |
| 481446 | 2460 | 2475 | TTCAGCACCTTCACCA | 3-10-3 | cEt | 44 | 206 |
| 481671 | 2461 | 2474 | TCAGCACCTTCACC | 2-10-2 | cEt | 41 | 207 |
| 481447 | 2476 | 2491 | GCCCTCCTGCTGAGGG | 3-10-3 | cEt | 10 | 208 |
| 481672 | 2477 | 2490 | CCCTCCTGCTGAGG | 2-10-2 | cEt | 15 | 209 |
| 481448 | 2484 | 2499 | CTCAAACTGCCCTCCT | 3-10-3 | cEt | 29 | 210 |
| 481797 | 2484 | 2497 | CAAACTGCCCTCCT | 2-10-2 | cEt | 11 | 211 |
| 481673 | 2485 | 2498 | TCAAACTGCCCTCC | 2-10-2 | cEt | 33 | 212 |
| 481449 | 2503 | 2518 | CCATGTCAAAGGTGAG | 3-10-3 | cEt | 77 | 213 |
| 481674 | 2504 | 2517 | CATGTCAAAGGTGA | 2-10-2 | cEt | 31 | 214 |
| 481450 | 2530 | 2545 | GGGAGGTAGCGCACTC | 3-10-3 | cEt | 53 | 215 |
| 481675 | 2531 | 2544 | GGAGGTAGCGCACT | 2-10-2 | cEt | 41 | 216 |
| 481451 | 2592 | 2607 | GAATGCAGGTAGGCGC | 3-10-3 | cEt | 55 | 217 |
| 481676 | 2593 | 2606 | AATGCAGGTAGGCG | 2-10-2 | cEt | 39 | 218 |
| 481452 | 2631 | 2646 | TTTCAGATGATCTGGG | 3-10-3 | cEt | 71 | 219 |
| 481677 | 2632 | 2645 | TTCAGATGATCTGG | 2-10-2 | cEt | 38 | 220 |
| 481574 | 2650 | 2665 | GGAACCACAAAGTTAG | 3-10-3 | cEt | 69 | 221 |
| 481799 | 2651 | 2664 | GAACCACAAAGTTA | 2-10-2 | cEt | 50 | 222 |

TABLE 1-continued

Inhibition of human STAT3 mRNA levels by cEt and MOE
chimeric antisense oligonucleotides targeted to SEQ ID NO: 1

| ISIS NO | Human Start Site | Human Stop Site | Sequence | Motif | Wing Chem | % inhibition | SEQ ID NO |
|---|---|---|---|---|---|---|---|
| 481453 | 2681 | 2696 | GATAGCAGAAGTAGGA | 3-10-3 | cEt | 92 | 223 |
| 481678 | 2682 | 2695 | ATAGCAGAAGTAGG | 2-10-2 | cEt | 78 | 224 |
| 481454 | 2702 | 2717 | AAAGTGCCCAGATTGC | 3-10-3 | cEt | 85 | 225 |
| 481679 | 2703 | 2716 | AAGTGCCCAGATTG | 2-10-2 | cEt | 69 | 226 |
| 481455 | 2722 | 2737 | CACTCATTTCTCTATT | 3-10-3 | cEt | 74 | 227 |
| 481680 | 2723 | 2736 | ACTCATTTCTCTAT | 2-10-2 | cEt | 39 | 228 |
| 481456 | 2767 | 2782 | AACACATCCTTATTTG | 3-10-3 | cEt | 48 | 229 |
| 481681 | 2768 | 2781 | ACACATCCTTATTT | 2-10-2 | cEt | 47 | 230 |
| 481457 | 2779 | 2794 | TGGGTCTCAGAGAACA | 3-10-3 | cEt | 88 | 231 |
| 481682 | 2780 | 2793 | GGGTCTCAGAGAAC | 2-10-2 | cEt | 77 | 232 |
| 481458 | 2832 | 2847 | CAAGACATTTCCTTTT | 3-10-3 | cEt | 54 | 233 |
| 481683 | 2833 | 2846 | AAGACATTTCCTTT | 2-10-2 | cEt | 29 | 234 |
| 481459 | 2908 | 2923 | GGAGGCACTTGTCTAA | 3-10-3 | cEt | 76 | 235 |
| 481684 | 2909 | 2922 | GAGGCACTTGTCTA | 2-10-2 | cEt | 89 | 236 |
| 481460 | 2943 | 2958 | TTACAGAAACAGGCAG | 3-10-3 | cEt | 83 | 237 |
| 481685 | 2944 | 2957 | TACAGAAACAGGCA | 2-10-2 | cEt | 36 | 238 |
| 481461 | 2969 | 2984 | AGCTATAGGTGGCCTG | 3-10-3 | cEt | 75 | 239 |
| 481686 | 2970 | 2983 | GCTATAGGTGGCCT | 2-10-2 | cEt | 70 | 240 |
| 481462 | 2984 | 2999 | ATGCCAGGAGTATGTA | 3-10-3 | cEt | 89 | 241 |
| 481687 | 2985 | 2998 | TGCCAGGAGTATGT | 2-10-2 | cEt | 80 | 242 |
| 481463 | 3001 | 3016 | CAAGGTTAAAAAGTGC | 3-10-3 | cEt | 88 | 243 |
| 481688 | 3002 | 3015 | AAGGTTAAAAAGTG | 2-10-2 | cEt | 13 | 244 |
| 481464 | 3016 | 3031 | CTATTTGGATGTCAGC | 3-10-3 | cEt | 97 | 245 |
| 481689 | 3017 | 3030 | TATTTGGATGTCAG | 2-10-2 | cEt | 40 | 246 |
| 481465 | 3032 | 3047 | TAGATAGTCCTATCTT | 3-10-3 | cEt | 51 | 247 |
| 481690 | 3033 | 3046 | AGATAGTCCTATCT | 2-10-2 | cEt | 64 | 248 |
| 481466 | 3047 | 3062 | AAGAAACCTAGGGCTT | 3-10-3 | cEt | 74 | 249 |
| 481691 | 3048 | 3061 | AGAAACCTAGGGCT | 2-10-2 | cEt | 77 | 250 |
| 481467 | 3097 | 3112 | GCTGATACAGTGTTTT | 3-10-3 | cEt | 74 | 251 |
| 481692 | 3098 | 3111 | CTGATACAGTGTTT | 2-10-2 | cEt | 74 | 252 |
| 481468 | 3112 | 3127 | ATACAGAAAGGCTATG | 3-10-3 | cEt | 71 | 253 |
| 481693 | 3113 | 3126 | TACAGAAAGGCTAT | 2-10-2 | cEt | 25 | 254 |
| 481469 | 3127 | 3142 | GCTTAAGTTTCTTAAA | 3-10-3 | cEt | 61 | 255 |
| 481694 | 3128 | 3141 | CTTAAGTTTCTTAA | 2-10-2 | cEt | 0 | 256 |
| 481470 | 3461 | 3476 | AGCACCAAGGAGGCTG | 3-10-3 | cEt | 49 | 257 |
| 481695 | 3462 | 3475 | GCACCAAGGAGGCT | 2-10-2 | cEt | 83 | 258 |

TABLE 1-continued

Inhibition of human STAT3 mRNA levels by cEt and MOE chimeric antisense oligonucleotides targeted to SEQ ID NO: 1

| ISIS NO | Human Start Site | Human Stop Site | Sequence | Motif | Wing Chem | % inhibition | SEQ ID NO |
|---|---|---|---|---|---|---|---|
| 481471 | 3476 | 3491 | AAGCTGAATGCTTAAA | 3-10-3 | cEt | 36 | 259 |
| 481696 | 3477 | 3490 | AGCTGAATGCTTAA | 2-10-2 | cEt | 33 | 260 |
| 481472 | 3491 | 3506 | TTACCAGCCTGAAGGA | 3-10-3 | cEt | 76 | 261 |
| 481697 | 3492 | 3505 | TACCAGCCTGAAGG | 2-10-2 | cEt | 63 | 262 |
| 481473 | 3506 | 3521 | CAGGGATTATATAAAT | 3-10-3 | cEt | 53 | 263 |
| 481698 | 3507 | 3520 | AGGGATTATATAAA | 2-10-2 | cEt | 15 | 264 |
| 481474 | 3521 | 3536 | ACCTGAAGCCCGTTTC | 3-10-3 | cEt | 80 | 265 |
| 481699 | 3522 | 3535 | CCTGAAGCCCGTTT | 2-10-2 | cEt | 57 | 266 |
| 481475 | 3536 | 3551 | TGTCTTAAGGGTTTGA | 3-10-3 | cEt | 93 | 267 |
| 481700 | 3537 | 3550 | GTCTTAAGGGTTTG | 2-10-2 | cEt | 89 | 268 |
| 481476 | 3551 | 3566 | GGTTGCAGCTTCAGAT | 3-10-3 | cEt | 92 | 269 |
| 481701 | 3552 | 3565 | GTTGCAGCTTCAGA | 2-10-2 | cEt | 60 | 270 |
| 481477 | 3567 | 3582 | TCAACACCAAAGGCCA | 3-10-3 | cEt | 95 | 271 |
| 481702 | 3568 | 3581 | CAACACCAAAGGCC | 2-10-2 | cEt | 89 | 272 |
| 481478 | 3585 | 3600 | TCCTTAAACCTTCCTA | 3-10-3 | cEt | 84 | 273 |
| 481703 | 3586 | 3599 | CCTTAAACCTTCCT | 2-10-2 | cEt | 57 | 274 |
| 481479 | 3600 | 3615 | AAAATGCTTAGATTCT | 3-10-3 | cEt | 80 | 275 |
| 481704 | 3601 | 3614 | AAATGCTTAGATTC | 2-10-2 | cEt | 32 | 276 |
| 481480 | 3628 | 3643 | AAATAAGTCTATTTAT | 3-10-3 | cEt | 5 | 277 |
| 481705 | 3629 | 3642 | AATAAGTCTATTTA | 2-10-2 | cEt | 25 | 278 |
| 481481 | 3648 | 3663 | GGCCAATACATTACAA | 3-10-3 | cEt | 63 | 279 |
| 481706 | 3649 | 3662 | GCCAATACATTACA | 2-10-2 | cEt | 56 | 280 |
| 481482 | 3670 | 3685 | TGCCCAGCCTTACTCA | 3-10-3 | cEt | 55 | 281 |
| 481707 | 3671 | 3684 | GCCCAGCCTTACTC | 2-10-2 | cEt | 43 | 282 |
| 481483 | 3685 | 3700 | GTTGTAAGCACCCTCT | 3-10-3 | cEt | 1 | 283 |
| 481708 | 3686 | 3699 | TTGTAAGCACCCTC | 2-10-2 | cEt | 56 | 284 |
| 481484 | 3700 | 3715 | AGAAAGGGAGTCAAGG | 3-10-3 | cEt | 60 | 285 |
| 481709 | 3701 | 3714 | GAAAGGGAGTCAAG | 2-10-2 | cEt | 27 | 286 |
| 481485 | 3717 | 3732 | GCAGATCAAGTCCAGG | 3-10-3 | cEt | 90 | 287 |
| 481710 | 3718 | 3731 | CAGATCAAGTCCAG | 2-10-2 | cEt | 88 | 288 |
| 481486 | 3730 | 3745 | AGCCTCTGAAACAGCA | 3-10-3 | cEt | 75 | 289 |
| 481711 | 3731 | 3744 | GCCTCTGAAACAGC | 2-10-2 | cEt | 74 | 290 |
| 481487 | 3746 | 3761 | CCCACAGAAACAACCT | 3-10-3 | cEt | 66 | 291 |
| 481712 | 3747 | 3760 | CCACAGAAACAACC | 2-10-2 | cEt | 45 | 292 |
| 481488 | 3761 | 3776 | AGCCCTGATAAGGCAC | 3-10-3 | cEt | 23 | 293 |
| 481713 | 3762 | 3775 | GCCCTGATAAGGCA | 2-10-2 | cEt | 18 | 294 |
| 481489 | 3776 | 3791 | AATCAGAAGTATCCCA | 3-10-3 | cEt | 60 | 295 |

TABLE 1-continued

Inhibition of human STAT3 mRNA levels by cEt and MOE chimeric antisense oligonucleotides targeted to SEQ ID NO: 1

| ISIS NO | Human Start Site | Human Stop Site | Sequence | Motif | Wing Chem | % inhibition | SEQ ID NO |
|---|---|---|---|---|---|---|---|
| 481714 | 3777 | 3790 | ATCAGAAGTATCCC | 2-10-2 | cEt | 43 | 296 |
| 481490 | 3833 | 3848 | GCCTCTAGCAGGATCA | 3-10-3 | cEt | 78 | 297 |
| 481715 | 3834 | 3847 | CCTCTAGCAGGATC | 2-10-2 | cEt | 79 | 298 |
| 481491 | 3848 | 3863 | CACGCAAGGAGACATG | 3-10-3 | cEt | 70 | 299 |
| 481716 | 3849 | 3862 | ACGCAAGGAGACAT | 2-10-2 | cEt | 68 | 300 |
| 481492 | 3863 | 3878 | TGAGGGACCTTTAGAC | 3-10-3 | cEt | 61 | 301 |
| 481717 | 3864 | 3877 | GAGGGACCTTTAGA | 2-10-2 | cEt | 44 | 302 |
| 481493 | 3886 | 3901 | CAGGATTCCTAAAACA | 3-10-3 | cEt | 43 | 303 |
| 481718 | 3887 | 3900 | AGGATTCCTAAAAC | 2-10-2 | cEt | 7 | 304 |
| 481494 | 3901 | 3916 | ATGAGGTCCTGAGACC | 3-10-3 | cEt | 60 | 305 |
| 481719 | 3902 | 3915 | TGAGGTCCTGAGAC | 2-10-2 | cEt | 29 | 306 |
| 481495 | 3940 | 3955 | CATCATGTCCAACCTG | 3-10-3 | cEt | 92 | 307 |
| 481720 | 3941 | 3954 | ATCATGTCCAACCT | 2-10-2 | cEt | 63 | 308 |
| 481496 | 3955 | 3970 | GGGCCCCATAGTGTGC | 3-10-3 | cEt | 29 | 309 |
| 481721 | 3956 | 3969 | GGCCCCATAGTGTG | 2-10-2 | cEt | 19 | 310 |
| 481497 | 3977 | 3992 | AGCTCAACCAGACACG | 3-10-3 | cEt | 67 | 311 |
| 481722 | 3978 | 3991 | GCTCAACCAGACAC | 2-10-2 | cEt | 69 | 312 |
| 481498 | 3992 | 4007 | GAACCATATTCCCTGA | 3-10-3 | cEt | 90 | 313 |
| 481723 | 3993 | 4006 | AACCATATTCCCTG | 2-10-2 | cEt | 49 | 314 |
| 481499 | 4007 | 4022 | CAAGAAACTGGCTAAG | 3-10-3 | cEt | 43 | 315 |
| 481724 | 4008 | 4021 | AAGAAACTGGCTAA | 2-10-2 | cEt | 17 | 316 |
| 481500 | 4022 | 4037 | GCCACTGGATATCACC | 3-10-3 | cEt | 92 | 317 |
| 481501 | 4048 | 4063 | AACTGAATGAAGACGC | 3-10-3 | cEt | 91 | 318 |
| 481726 | 4049 | 4062 | ACTGAATGAAGACG | 2-10-2 | cEt | 56 | 319 |
| 481502 | 4063 | 4078 | CCTTTGCCCTGCATGA | 3-10-3 | cEt | 85 | 320 |
| 481727 | 4064 | 4077 | CTTTGCCCTGCATG | 2-10-2 | cEt | 70 | 321 |
| 481503 | 4078 | 4093 | AAGTTTATCAGTAAGC | 3-10-3 | cEt | 57 | 322 |
| 481728 | 4079 | 4092 | AGTTTATCAGTAAG | 2-10-2 | cEt | 22 | 323 |
| 481504 | 4093 | 4108 | TACGAGGGCAGACTCA | 3-10-3 | cEt | 60 | 324 |
| 481729 | 4094 | 4107 | ACGAGGGCAGACTC | 2-10-2 | cEt | 22 | 325 |
| 481505 | 4108 | 4123 | AGGTATACACCCTCAT | 3-10-3 | cEt | 45 | 326 |
| 481730 | 4109 | 4122 | GGTATACACCCTCA | 2-10-2 | cEt | 47 | 327 |
| 481506 | 4123 | 4138 | CCTCAGAGGGAGGCCA | 3-10-3 | cEt | 32 | 328 |
| 481731 | 4124 | 4137 | CTCAGAGGGAGGCC | 2-10-2 | cEt | 0 | 329 |
| 481507 | 4138 | 4153 | GGGAGGAGTCACCAGC | 3-10-3 | cEt | 64 | 330 |
| 481732 | 4139 | 4152 | GGAGGAGTCACCAG | 2-10-2 | cEt | 59 | 331 |

TABLE 1-continued

Inhibition of human STAT3 mRNA levels by cEt and MOE
chimeric antisense oligonucleotides targeted to SEQ ID NO: 1

| ISIS NO | Human Start Site | Human Stop Site | Sequence | Motif | Wing Chem | % inhibition | SEQ ID NO |
|---|---|---|---|---|---|---|---|
| 481508 | 4205 | 4220 | TAGCCAGCCAAGGCGG | 3-10-3 | cEt | 33 | 332 |
| 481733 | 4206 | 4219 | AGCCAGCCAAGGCG | 2-10-2 | cEt | 50 | 333 |
| 481509 | 4220 | 4235 | ACAGGAGAGGCGAGCT | 3-10-3 | cEt | 46 | 334 |
| 481734 | 4221 | 4234 | CAGGAGAGGCGAGC | 2-10-2 | cEt | 28 | 335 |
| 481510 | 4237 | 4252 | TAGGTGTTCCCATACG | 3-10-3 | cEt | 95 | 336 |
| 481735 | 4238 | 4251 | AGGTGTTCCCATAC | 2-10-2 | cEt | 22 | 337 |
| 481511 | 4258 | 4273 | GGCAGCCCATCCAGCA | 3-10-3 | cEt | 43 | 338 |
| 481736 | 4259 | 4272 | GCAGCCCATCCAGC | 2-10-2 | cEt | 54 | 339 |
| 481512 | 4275 | 4290 | CATGCCTCTGAGTCAG | 3-10-3 | cEt | 30 | 340 |
| 481737 | 4276 | 4289 | ATGCCTCTGAGTCA | 2-10-2 | cEt | 31 | 341 |
| 481513 | 4290 | 4305 | GTTGCCAAATCCGGCC | 3-10-3 | cEt | 85 | 342 |
| 481738 | 4291 | 4304 | TTGCCAAATCCGGC | 2-10-2 | cEt | 70 | 343 |
| 481514 | 4305 | 4320 | GCAAGGTGGTTTTGAG | 3-10-3 | cEt | 85 | 344 |
| 481739 | 4306 | 4319 | CAAGGTGGTTTTGA | 2-10-2 | cEt | 60 | 345 |
| 481515 | 4325 | 4340 | AGAAACTCTGATCAGC | 3-10-3 | cEt | 88 | 346 |
| 481740 | 4326 | 4339 | GAAACTCTGATCAG | 2-10-2 | cEt | 71 | 347 |
| 481516 | 4364 | 4379 | CAGAGACCAGCTAATT | 3-10-3 | cEt | 78 | 348 |
| 481741 | 4365 | 4378 | AGAGACCAGCTAAT | 2-10-2 | cEt | 80 | 349 |
| 481517 | 4394 | 4409 | ATCTTAGAGAAGGTCG | 3-10-3 | cEt | 87 | 350 |
| 481742 | 4395 | 4408 | TCTTAGAGAAGGTC | 2-10-2 | cEt | 64 | 351 |
| 481518 | 4425 | 4440 | CCAGGCAGGAGGACTG | 3-10-3 | cEt | 67 | 352 |
| 481743 | 4426 | 4439 | CAGGCAGGAGGACT | 2-10-2 | cEt | 75 | 353 |
| 481519 | 4437 | 4452 | CATCAACTGTCTCCAG | 3-10-3 | cEt | 29 | 354 |
| 481744 | 4438 | 4451 | ATCAACTGTCTCCA | 2-10-2 | cEt | 69 | 355 |
| 481520 | 4439 | 4454 | CACATCAACTGTCTCC | 3-10-3 | cEt | 73 | 356 |
| 481745 | 4440 | 4453 | ACATCAACTGTCTC | 2-10-2 | cEt | 74 | 357 |
| 481521 | 4459 | 4474 | GAAGTAAGAGCTCTGC | 3-10-3 | cEt | 86 | 358 |
| 481746 | 4460 | 4473 | AAGTAAGAGCTCTG | 2-10-2 | cEt | 67 | 359 |
| 481522 | 4474 | 4489 | AAGAGTGTTGCTGGAG | 3-10-3 | cEt | 92 | 360 |
| 481747 | 4475 | 4488 | AGAGTGTTGCTGGA | 2-10-2 | cEt | 95 | 361 |
| 481523 | 4489 | 4504 | GCTTATTATGTACTGA | 3-10-3 | cEt | 95 | 362 |
| 481748 | 4490 | 4503 | CTTATTATGTACTG | 2-10-2 | cEt | 15 | 363 |
| 481524 | 4530 | 4545 | GCCCAAGTCTCACCTT | 3-10-3 | cEt | 70 | 364 |
| 481749 | 4531 | 4544 | CCCAAGTCTCACCT | 2-10-2 | cEt | 70 | 365 |
| 481525 | 4541 | 4556 | CCCAATGGTAAGCCCA | 3-10-3 | cEt | 93 | 366 |
| 481750 | 4542 | 4555 | CCAATGGTAAGCCC | 2-10-2 | cEt | 94 | 367 |
| 481526 | 4543 | 4558 | AACCCAATGGTAAGCC | 3-10-3 | cEt | 82 | 368 |

TABLE 1-continued

Inhibition of human STAT3 mRNA levels by cEt and MOE
chimeric antisense oligonucleotides targeted to SEQ ID NO: 1

| ISIS NO | Human Start Site | Human Stop Site | Sequence | Motif | Wing Chem | % inhibition | SEQ ID NO |
|---|---|---|---|---|---|---|---|
| 481751 | 4544 | 4557 | ACCCAATGGTAAGC | 2-10-2 | cEt | 54 | 369 |
| 481527 | 4560 | 4575 | TAGGTCCCTATGATTT | 3-10-3 | cEt | 55 | 370 |
| 481752 | 4561 | 4574 | AGGTCCCTATGATT | 2-10-2 | cEt | 62 | 371 |
| 481528 | 4579 | 4594 | AAGCCCTGAACCCTCG | 3-10-3 | cEt | 77 | 372 |
| 481753 | 4580 | 4593 | AGCCCTGAACCCTC | 2-10-2 | cEt | 71 | 373 |
| 481529 | 4615 | 4630 | CCTAAGGCCATGAACT | 3-10-3 | cEt | 64 | 374 |
| 481754 | 4616 | 4629 | CTAAGGCCATGAAC | 2-10-2 | cEt | 53 | 375 |
| 481530 | 4630 | 4645 | ACCAGATACATGCTAC | 3-10-3 | cEt | 87 | 376 |
| 481755 | 4631 | 4644 | CCAGATACATGCTA | 2-10-2 | cEt | 84 | 377 |
| 481531 | 4646 | 4661 | TACAATCAGAGTTAAG | 3-10-3 | cEt | 66 | 378 |
| 481756 | 4647 | 4660 | ACAATCAGAGTTAA | 2-10-2 | cEt | 5 | 379 |
| 481532 | 4664 | 4679 | TCCTCTCAGAACTTTT | 3-10-3 | cEt | 65 | 380 |
| 481757 | 4665 | 4678 | CCTCTCAGAACTTT | 2-10-2 | cEt | 81 | 381 |
| 481533 | 4666 | 4681 | GCTCCTCTCAGAACTT | 3-10-3 | cEt | 80 | 382 |
| 481758 | 4667 | 4680 | CTCCTCTCAGAACT | 2-10-2 | cEt | 62 | 383 |
| 481534 | 4693 | 4708 | TTCTTTAATGGGCCAC | 3-10-3 | cEt | 79 | 384 |
| 481759 | 4694 | 4707 | TCTTTAATGGGCCA | 2-10-2 | cEt | 74 | 385 |
| 481535 | 4767 | 4782 | ACGGGATTCCCTCGGC | 3-10-3 | cEt | 78 | 386 |
| 481760 | 4768 | 4781 | CGGGATTCCCTCGG | 2-10-2 | cEt | 78 | 387 |
| 481536 | 4782 | 4797 | GTAGGTAAGCAACCCA | 3-10-3 | cEt | 91 | 388 |
| 481761 | 4783 | 4796 | TAGGTAAGCAACCC | 2-10-2 | cEt | 78 | 389 |
| 481537 | 4830 | 4845 | GAATTTGAATGCAGTG | 3-10-3 | cEt | 84 | 390 |
| 481762 | 4831 | 4844 | AATTTGAATGCAGT | 2-10-2 | cEt | 2 | 391 |
| 481538 | 4844 | 4859 | TGAAGTACACATTGGA | 3-10-3 | cEt | 92 | 392 |
| 481763 | 4845 | 4858 | GAAGTACACATTGG | 2-10-2 | cEt | 96 | 393 |
| 481539 | 4860 | 4875 | ATAAATTTTTACACTA | 3-10-3 | cEt | 19 | 394 |
| 481764 | 4861 | 4874 | TAAATTTTTACACT | 2-10-2 | cEt | 1 | 395 |
| 481765 | 4869 | 4882 | CAATAATATAAATT | 2-10-2 | cEt | 0 | 396 |
| 481541 | 4934 | 4949 | CTGGAAGTTAAAGTAG | 3-10-3 | cEt | 71 | 397 |
| 481766 | 4935 | 4948 | TGGAAGTTAAAGTA | 2-10-2 | cEt | 10 | 398 |

TABLE 2

Inhibition of human STAT3 mRNA levels by cEt and MOE chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481350 | 1065 | 1080 | TCCAGGATCCGGTTGG | 3-10-3 | cEt | 52 | 9 |
| 481575 | 1066 | 1079 | CCAGGATCCGGTTG | 2-10-2 | cEt | 41 | 10 |
| 481351 | 1121 | 1136 | GGCCGAAGGGCCTCTC | 3-10-3 | cEt | 14 | 11 |
| 481576 | 1122 | 1135 | GCCGAAGGGCCTCT | 2-10-2 | cEt | 8 | 12 |
| 481542 | 1988 | 2003 | GGCTCAATTATTTATC | 3-10-3 | cEt | 64 | 399 |
| 481767 | 1989 | 2002 | GCTCAATTATTTAT | 2-10-2 | cEt | 0 | 400 |
| 481543 | 1996 | 2011 | AATGCAATGGCTCAAT | 3-10-3 | cEt | 84 | 401 |
| 481768 | 1997 | 2010 | ATGCAATGGCTCAA | 2-10-2 | cEt | 95 | 402 |
| 481544 | 2004 | 2019 | ATCCAGTAAATGCAAT | 3-10-3 | cEt | 58 | 403 |
| 481769 | 2005 | 2018 | TCCAGTAAATGCAA | 2-10-2 | cEt | 55 | 404 |
| 481545 | 2061 | 2076 | AGAAAACTCCCACTCT | 3-10-3 | cEt | 36 | 405 |
| 481770 | 2062 | 2075 | GAAAACTCCCACTC | 2-10-2 | cEt | 42 | 406 |
| 481546 | 2113 | 2128 | CTGTCTTTGTTTCCCT | 3-10-3 | cEt | 70 | 407 |
| 481771 | 2114 | 2127 | TGTCTTTGTTTCCC | 2-10-2 | cEt | 75 | 408 |
| 481547 | 2121 | 2136 | AGGCCAGCCTGTCTTT | 3-10-3 | cEt | 87 | 409 |
| 481772 | 2122 | 2135 | GGCCAGCCTGTCTT | 2-10-2 | cEt | 53 | 410 |
| 481548 | 2705 | 2720 | CTAATGGTTCTTTGTG | 3-10-3 | cEt | 78 | 411 |
| 481773 | 2706 | 2719 | TAATGGTTCTTTGT | 2-10-2 | cEt | 9 | 412 |
| 481549 | 6476 | 6491 | GAAATTCATTCTTCCA | 3-10-3 | cEt | 96 | 413 |
| 481774 | 6477 | 6490 | AAATTCATTCTTCC | 2-10-2 | cEt | 56 | 414 |
| 481550 | 10001 | 10016 | ACACACACAGATGTGA | 3-10-3 | cEt | 48 | 415 |
| 481775 | 10002 | 10015 | CACACACAGATGTG | 2-10-2 | cEt | 35 | 416 |
| 481551 | 10337 | 10352 | CTACCCAAACATCCCC | 3-10-3 | cEt | 69 | 417 |
| 481776 | 10338 | 10351 | TACCCAAACATCCC | 2-10-2 | cEt | 62 | 418 |
| 481552 | 10345 | 10360 | TACAAAAACTACCCAA | 3-10-3 | cEt | 30 | 419 |
| 481777 | 10346 | 10359 | ACAAAAACTACCCA | 2-10-2 | cEt | 1 | 420 |
| 481553 | 10364 | 10379 | AGTTTTCAGAAATGGC | 3-10-3 | cEt | 96 | 421 |
| 481778 | 10365 | 10378 | GTTTTCAGAAATGG | 2-10-2 | cEt | 47 | 422 |
| 481554 | 15469 | 15484 | CAAGCTTTTCTATGAA | 3-10-3 | cEt | 86 | 423 |
| 481779 | 15470 | 15483 | AAGCTTTTCTATGA | 2-10-2 | cEt | 60 | 424 |
| 481555 | 24588 | 24603 | TTATTCAGGTCACTTT | 3-10-3 | cEt | 73 | 425 |
| 481780 | 24589 | 24602 | TATTCAGGTCACTT | 2-10-2 | cEt | 60 | 426 |
| 481352 | 40953 | 40968 | CCTGCTAAAATCAGGG | 3-10-3 | cEt | 15 | 13 |
| 481577 | 40954 | 40967 | CTGCTAAAATCAGG | 2-10-2 | cEt | 12 | 14 |
| 481353 | 40968 | 40983 | ATTCCATTGGGCCATC | 3-10-3 | cEt | 78 | 15 |
| 481578 | 40969 | 40982 | TTCCATTGGGCCAT | 2-10-2 | cEt | 51 | 16 |
| 481354 | 40992 | 41007 | CCGTGTGTCAAGCTGC | 3-10-3 | cEt | 98 | 17 |

TABLE 2-continued

Inhibition of human STAT3 mRNA levels by cEt and MOE chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481579 | 40993 | 41006 | CGTGTGTCAAGCTG | 2-10-2 | cEt | 91 | 18 |
| 481355 | 41050 | 41065 | ACTGCCGCAGCTCCAT | 3-10-3 | cEt | 95 | 19 |
| 481580 | 41051 | 41064 | CTGCCGCAGCTCCA | 2-10-2 | cEt | 76 | 20 |
| 481356 | 41074 | 41089 | GACTCTCAATCCAAGG | 3-10-3 | cEt | 83 | 21 |
| 481581 | 41075 | 41088 | ACTCTCAATCCAAG | 2-10-2 | cEt | 31 | 22 |
| 481556 | 42765 | 42780 | GCATATGCCCTAGGAA | 3-10-3 | cEt | 23 | 430 |
| 481781 | 42766 | 42779 | CATATGCCCTAGGA | 2-10-2 | cEt | 15 | 431 |
| 481357 | 42778 | 42793 | TTCTTTGCTGGCCGCA | 3-10-3 | cEt | 97 | 23 |
| 481582 | 42779 | 42792 | TCTTTGCTGGCCGC | 2-10-2 | cEt | 87 | 24 |
| 481358 | 42806 | 42821 | GATTATGAAACACCAA | 3-10-3 | cEt | 85 | 25 |
| 481583 | 42807 | 42820 | ATTATGAAACACCA | 2-10-2 | cEt | 20 | 26 |
| 481359 | 42832 | 42847 | ATACTGCTGGTCAATC | 3-10-3 | cEt | 90 | 27 |
| 481584 | 42833 | 42846 | TACTGCTGGTCAAT | 2-10-2 | cEt | 42 | 28 |
| 481360 | 42862 | 42877 | GAGAACATTCGACTCT | 3-10-3 | cEt | 75 | 29 |
| 481585 | 42863 | 42876 | AGAACATTCGACTC | 2-10-2 | cEt | 77 | 30 |
| 481361 | 42877 | 42892 | TAGATTGTGCTGATAG | 3-10-3 | cEt | 90 | 31 |
| 481586 | 42878 | 42891 | AGATTGTGCTGATA | 2-10-2 | cEt | 81 | 32 |
| 481362 | 42893 | 42908 | ACTGCTTGATTCTTCG | 3-10-3 | cEt | 59 | 33 |
| 481587 | 42894 | 42907 | CTGCTTGATTCTTC | 2-10-2 | cEt | 23 | 34 |
| 481557 | 43043 | 43058 | GCTAATTACTTCTCCT | 3-10-3 | cEt | 57 | 432 |
| 481782 | 43044 | 43057 | CTAATTACTTCTCC | 2-10-2 | cEt | 25 | 433 |
| 481588 | 43826 | 43839 | AAGATACCTGCTCT | 2-10-2 | cEt | 58 | 36 |
| 481364 | 43856 | 43871 | GCCACAATCCGGGCAA | 3-10-3 | cEt | 36 | 37 |
| 481589 | 43857 | 43870 | CCACAATCCGGGCA | 2-10-2 | cEt | 69 | 38 |
| 481365 | 43903 | 43918 | CAGTGGCTGCAGTCTG | 3-10-3 | cEt | 36 | 39 |
| 481590 | 43904 | 43917 | AGTGGCTGCAGTCT | 2-10-2 | cEt | 30 | 40 |
| 481558 | 50069 | 50084 | GCCCCCTTGCTGCCAA | 3-10-3 | cEt | 0 | 434 |
| 481783 | 50070 | 50083 | CCCCCTTGCTGCCA | 2-10-2 | cEt | 39 | 435 |
| 481367 | 50101 | 50116 | GTCACCACGGCTGCTG | 3-10-3 | cEt | 70 | 43 |
| 481592 | 50102 | 50115 | TCACCACGGCTGCT | 2-10-2 | cEt | 48 | 44 |
| 481368 | 50122 | 50137 | TCCAGCATCTGCTGCT | 3-10-3 | cEt | 81 | 45 |
| 481593 | 50123 | 50136 | CCAGCATCTGCTGC | 2-10-2 | cEt | 46 | 46 |
| 481369 | 50138 | 50153 | ATCCTGAAGGTGCTGC | 3-10-3 | cEt | 29 | 47 |
| 481594 | 50139 | 50152 | TCCTGAAGGTGCTG | 2-10-2 | cEt | 16 | 48 |
| 481559 | 50668 | 50683 | TGTTCTAGATCCTGTT | 3-10-3 | cEt | 72 | 436 |
| 481784 | 50669 | 50682 | GTTCTAGATCCTGT | 2-10-2 | cEt | 79 | 437 |

TABLE 2-continued

Inhibition of human STAT3 mRNA levels by cEt and MOE chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481371 | 50673 | 50688 | TTTTCTGTTCTAGATC | 3-10-3 | cEt | 83 | 51 |
| 481596 | 50674 | 50687 | TTTCTGTTCTAGAT | 2-10-2 | cEt | 48 | 52 |
| 481372 | 50694 | 50709 | GGAGATTCTCTACCAC | 3-10-3 | cEt | 85 | 53 |
| 481597 | 50695 | 50708 | GAGATTCTCTACCA | 2-10-2 | cEt | 80 | 54 |
| 481373 | 50715 | 50730 | AGTTGAAATCAAAGTC | 3-10-3 | cEt | 87 | 55 |
| 481598 | 50716 | 50729 | GTTGAAATCAAAGT | 2-10-2 | cEt | 6 | 56 |
| 481599 | 51626 | 51639 | GATCTTGCATGTCT | 2-10-2 | cEt | 51 | 58 |
| 481375 | 51636 | 51651 | TGTTTCCATTCAGATC | 3-10-3 | cEt | 65 | 59 |
| 481600 | 51637 | 51650 | GTTTCCATTCAGAT | 2-10-2 | cEt | 42 | 60 |
| 481376 | 51705 | 51720 | TCCGCATCTGGTCCAG | 3-10-3 | cEt | 82 | 61 |
| 481601 | 51706 | 51719 | CCGCATCTGGTCCA | 2-10-2 | cEt | 70 | 62 |
| 481560 | 51708 | 51723 | CTCTCCGCATCTGGTC | 3-10-3 | cEt | 63 | 438 |
| 481785 | 51709 | 51722 | TCTCCGCATCTGGT | 2-10-2 | cEt | 28 | 63 |
| 481378 | 51905 | 51920 | CCGCCAGCTCACTCAC | 3-10-3 | cEt | 89 | 66 |
| 481603 | 51906 | 51919 | CGCCAGCTCACTCA | 2-10-2 | cEt | 60 | 67 |
| 481379 | 51968 | 51983 | TCCAGTCAGCCAGCTC | 3-10-3 | cEt | 91 | 68 |
| 481604 | 51969 | 51982 | CCAGTCAGCCAGCT | 2-10-2 | cEt | 70 | 69 |
| 481380 | 51976 | 51991 | CCGCCTCTTCCAGTCA | 3-10-3 | cEt | 73 | 70 |
| 481605 | 51977 | 51990 | CGCCTCTTCCAGTC | 2-10-2 | cEt | 55 | 71 |
| 481381 | 52023 | 52038 | CGATCTAGGCAGATGT | 3-10-3 | cEt | 26 | 72 |
| 481606 | 52024 | 52037 | GATCTAGGCAGATG | 2-10-2 | cEt | 35 | 73 |
| 481382 | 55443 | 55458 | GAGATTCTGCTAATGA | 3-10-3 | cEt | 81 | 74 |
| 481607 | 55444 | 55457 | AGATTCTGCTAATG | 2-10-2 | cEt | 51 | 75 |
| 481383 | 55451 | 55466 | CTGAAGTTGAGATTCT | 3-10-3 | cEt | 84 | 76 |
| 481608 | 55452 | 55465 | TGAAGTTGAGATTC | 2-10-2 | cEt | 26 | 77 |
| 481384 | 55496 | 55511 | AACTTTTGCTGCAAC | 3-10-3 | cEt | 76 | 78 |
| 481609 | 55497 | 55510 | ACTTTTGCTGCAA | 2-10-2 | cEt | 34 | 79 |
| 481385 | 55511 | 55526 | GTCCCCTTTGTAGGAA | 3-10-3 | cEt | 41 | 80 |
| 481610 | 55512 | 55525 | TCCCCTTTGTAGGA | 2-10-2 | cEt | 37 | 81 |
| 481387 | 55748 | 55763 | CAGGATGCATGGGCAT | 3-10-3 | cEt | 92 | 84 |
| 481612 | 55749 | 55762 | AGGATGCATGGGCA | 2-10-2 | cEt | 86 | 85 |
| 481388 | 55792 | 55807 | TTTAGTAGTGAACTGG | 3-10-3 | cEt | 74 | 86 |
| 481613 | 55793 | 55806 | TTAGTAGTGAACTG | 2-10-2 | cEt | 22 | 87 |
| 481561 | 57949 | 57964 | TGACCAGCAACCTATT | 3-10-3 | cEt | 43 | 439 |
| 481786 | 57950 | 57963 | GACCAGCAACCTAT | 2-10-2 | cEt | 59 | 440 |
| 481390 | 57969 | 57984 | ATAATTCAACTCAGGG | 3-10-3 | cEt | 92 | 90 |
| 481615 | 57970 | 57983 | TAATTCAACTCAGG | 2-10-2 | cEt | 48 | 91 |

TABLE 2-continued

Inhibition of human STAT3 mRNA levels by cEt and MOE
chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481391 | 57978 | 57993 | TTTAAGCTGATAATTC | 3-10-3 | cEt | 44 | 92 |
| 481616 | 57979 | 57992 | TTAAGCTGATAATT | 2-10-2 | cEt | 0 | 93 |
| 481392 | 57990 | 58005 | GCACACTTTAATTTTA | 3-10-3 | cEt | 49 | 94 |
| 481617 | 57991 | 58004 | CACACTTTAATTTT | 2-10-2 | cEt | 1 | 95 |
| 481562 | 59703 | 59718 | CCCAGAGTCTCTGTAA | 3-10-3 | cEt | 36 | 441 |
| 481787 | 59704 | 59717 | CCAGAGTCTCTGTA | 2-10-2 | cEt | 22 | 442 |
| 481394 | 59895 | 59910 | GAGGCTGCCGTTGTTG | 3-10-3 | cEt | 62 | 98 |
| 481619 | 59896 | 59909 | AGGCTGCCGTTGTT | 2-10-2 | cEt | 29 | 99 |
| 481396 | 60034 | 60049 | CACATCTCTGCTCCCT | 3-10-3 | cEt | 92 | 102 |
| 481621 | 60035 | 60048 | ACATCTCTGCTCCC | 2-10-2 | cEt | 74 | 103 |
| 481563 | 60064 | 60079 | TTACATCACAATTGGC | 3-10-3 | cEt | 24 | 445 |
| 481788 | 60065 | 60078 | TACATCACAATTGG | 2-10-2 | cEt | 3 | 446 |
| 481398 | 63306 | 63321 | GATCAGGTGCAGCTCC | 3-10-3 | cEt | 73 | 106 |
| 481623 | 63307 | 63320 | ATCAGGTGCAGCTC | 2-10-2 | cEt | 40 | 107 |
| 481399 | 63327 | 63342 | ATACACCTCGGTCTCA | 3-10-3 | cEt | 73 | 108 |
| 481624 | 63328 | 63341 | TACACCTCGGTCTC | 2-10-2 | cEt | 43 | 109 |
| 481400 | 63343 | 63358 | TCTTGAGGCCTTGGTG | 3-10-3 | cEt | 47 | 110 |
| 481625 | 63344 | 63357 | CTTGAGGCCTTGGT | 2-10-2 | cEt | 16 | 111 |
| 481401 | 63353 | 63368 | TCTAGGTCAATCTTGA | 3-10-3 | cEt | 74 | 112 |
| 481626 | 63354 | 63367 | CTAGGTCAATCTTG | 2-10-2 | cEt | 54 | 113 |
| 481564 | 64421 | 64436 | GCAAGGAGTGGGTCTG | 3-10-3 | cEt | 33 | 446 |
| 481789 | 64422 | 64435 | CAAGGAGTGGGTCT | 2-10-2 | cEt | 10 | 116 |
| 481403 | 64425 | 64440 | ACTGGCAAGGAGTGGG | 3-10-3 | cEt | 58 | 117 |
| 481628 | 64426 | 64439 | CTGGCAAGGAGTGG | 2-10-2 | cEt | 38 | 118 |
| 481404 | 64451 | 64466 | TCTGACAGATGTTGGA | 3-10-3 | cEt | 50 | 119 |
| 481629 | 64452 | 64465 | CTGACAGATGTTGG | 2-10-2 | cEt | 64 | 120 |
| 481405 | 64459 | 64474 | ATTTGGCATCTGACAG | 3-10-3 | cEt | 75 | 121 |
| 481630 | 64460 | 64473 | TTTGGCATCTGACA | 2-10-2 | cEt | 39 | 122 |
| 481407 | 64663 | 64678 | CCCAGGTTCCAATTGG | 3-10-3 | cEt | 50 | 125 |
| 481632 | 64664 | 64677 | CCAGGTTCCAATTG | 2-10-2 | cEt | 32 | 126 |
| 481408 | 64714 | 64729 | CTCGCTTGGTGGTGGA | 3-10-3 | cEt | 53 | 127 |
| 481633 | 64715 | 64728 | TCGCTTGGTGGTGG | 2-10-2 | cEt | 35 | 128 |
| 481409 | 64729 | 64744 | GCTCGATGCTCAGTCC | 3-10-3 | cEt | 86 | 129 |
| 481634 | 64730 | 64743 | CTCGATGCTCAGTC | 2-10-2 | cEt | 43 | 130 |
| 481410 | 64759 | 64774 | CCAAGAGTTTCTCTGC | 3-10-3 | cEt | 91 | 131 |
| 481635 | 64760 | 64773 | CAAGAGTTTCTCTG | 2-10-2 | cEt | 43 | 132 |

TABLE 2-continued

Inhibition of human STAT3 mRNA levels by cEt and MOE
chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481411 | 65859 | 65874 | AATTCACACCAGGTCC | 3-10-3 | cEt | 72 | 133 |
| 481636 | 65860 | 65873 | ATTCACACCAGGTC | 2-10-2 | cEt | 42 | 134 |
| 481412 | 65877 | 65892 | TGATCTGACACCCTGA | 3-10-3 | cEt | 90 | 135 |
| 481637 | 65878 | 65891 | GATCTGACACCCTG | 2-10-2 | cEt | 79 | 136 |
| 481413 | 65885 | 65900 | AGCCCATGTGATCTGA | 3-10-3 | cEt | 80 | 137 |
| 481638 | 65886 | 65899 | GCCCATGTGATCTG | 2-10-2 | cEt | 64 | 138 |
| 481565 | 66119 | 66134 | TTTCCTGGAGAAAAGA | 3-10-3 | cEt | 4 | 447 |
| 481790 | 66120 | 66133 | TTCCTGGAGAAAAG | 2-10-2 | cEt | 3 | 448 |
| 481566 | 66127 | 66142 | AGCCATGTTTTCCTGG | 3-10-3 | cEt | 62 | 449 |
| 481791 | 66128 | 66141 | GCCATGTTTTCCTG | 2-10-2 | cEt | 73 | 450 |
| 481415 | 66133 | 66148 | CTTGCCAGCCATGTTT | 3-10-3 | cEt | 88 | 141 |
| 481640 | 66134 | 66147 | TTGCCAGCCATGTT | 2-10-2 | cEt | 57 | 142 |
| 337332 | 66135 | 66154 | GAAGCCCTTGCCAGCCATGT | 5-10-5 | MOE | 63 | 143 |
| 481416 | 66138 | 66153 | AAGCCCTTGCCAGCCA | 3-10-3 | cEt | 87 | 144 |
| 481641 | 66139 | 66152 | AGCCCTTGCCAGCC | 2-10-2 | cEt | 68 | 145 |
| 337333 | 66140 | 66159 | AAGGAGAAGCCCTTGCCAGC | 5-10-5 | MOE | 49 | 146 |
| 481417 | 66140 | 66155 | AGAAGCCCTTGCCAGC | 3-10-3 | cEt | 97 | 147 |
| 481418 | 66141 | 66156 | GAGAAGCCCTTGCCAG | 3-10-3 | cEt | 92 | 148 |
| 481642 | 66141 | 66154 | GAAGCCCTTGCCAG | 2-10-2 | cEt | 67 | 149 |
| 481419 | 66142 | 66157 | GGAGAAGCCCTTGCCA | 3-10-3 | cEt | 83 | 150 |
| 481643 | 66142 | 66155 | AGAAGCCCTTGCCA | 2-10-2 | cEt | 58 | 151 |
| 481644 | 66143 | 66156 | GAGAAGCCCTTGCC | 2-10-2 | cEt | 45 | 152 |
| 481420 | 66185 | 66200 | ACTTTTTCACAAGGTC | 3-10-3 | cEt | 94 | 153 |
| 481645 | 66186 | 66199 | CTTTTTCACAAGGT | 2-10-2 | cEt | 50 | 154 |
| 481421 | 66374 | 66389 | CTCAAGATGGCCCGCT | 3-10-3 | cEt | 86 | 155 |
| 481646 | 66375 | 66388 | TCAAGATGGCCCGC | 2-10-2 | cEt | 41 | 156 |
| 481422 | 66389 | 66404 | CCTGGAGGCTTAGTGC | 3-10-3 | cEt | 80 | 157 |
| 481647 | 66390 | 66403 | CTGGAGGCTTAGTG | 2-10-2 | cEt | 0 | 158 |
| 481423 | 66430 | 66445 | CTCCTTCTTTGCTGCT | 3-10-3 | cEt | 69 | 159 |
| 481648 | 66431 | 66444 | TCCTTCTTTGCTGC | 2-10-2 | cEt | 51 | 160 |
| 481424 | 66446 | 66461 | CAAGTGAAAGTGACGC | 3-10-3 | cEt | 70 | 161 |
| 481649 | 66447 | 66460 | AAGTGAAAGTGACG | 2-10-2 | cEt | 25 | 162 |
| 481425 | 66468 | 66483 | ACCGCTGATGTCCTTC | 3-10-3 | cEt | 78 | 163 |
| 481650 | 66469 | 66482 | CCGCTGATGTCCTT | 2-10-2 | cEt | 79 | 164 |
| 481426 | 66993 | 67008 | ACTGGATCTGGGTCTT | 3-10-3 | cEt | 80 | 165 |
| 481651 | 66994 | 67007 | CTGGATCTGGGTCT | 2-10-2 | cEt | 64 | 166 |
| 481427 | 67017 | 67032 | GCTGCTTTGTGTATGG | 3-10-3 | cEt | 75 | 167 |

TABLE 2-continued

Inhibition of human STAT3 mRNA levels by cEt and MOE chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481652 | 67018 | 67031 | CTGCTTTGTGTATG | 2-10-2 | cEt | 82 | 168 |
| 481428 | 67026 | 67041 | TGTTCAGCTGCTGCTT | 3-10-3 | cEt | 77 | 169 |
| 481653 | 67027 | 67040 | GTTCAGCTGCTGCT | 2-10-2 | cEt | 79 | 170 |
| 481429 | 67034 | 67049 | TGACATGTTGTTCAGC | 3-10-3 | cEt | 84 | 171 |
| 481654 | 67035 | 67048 | GACATGTTGTTCAG | 2-10-2 | cEt | 70 | 172 |
| 481430 | 67052 | 67067 | CATGATGATTTCAGCA | 3-10-3 | cEt | 67 | 173 |
| 481655 | 67053 | 67066 | ATGATGATTTCAGC | 2-10-2 | cEt | 31 | 174 |
| 481431 | 67068 | 67083 | CCATGATCTTATAGCC | 3-10-3 | cEt | 91 | 175 |
| 481656 | 67069 | 67082 | CATGATCTTATAGC | 2-10-2 | cEt | 0 | 176 |
| 481432 | 67095 | 67110 | GTGGAGACACCAGGAT | 3-10-3 | cEt | 55 | 177 |
| 481657 | 67096 | 67109 | TGGAGACACCAGGA | 2-10-2 | cEt | 58 | 178 |
| 481433 | 67118 | 67133 | AATGTCAGGATAGAGA | 3-10-3 | cEt | 73 | 179 |
| 481658 | 67119 | 67132 | ATGTCAGGATAGAG | 2-10-2 | cEt | 62 | 180 |
| 481434 | 67128 | 67143 | CCTCCTTGGGAATGTC | 3-10-3 | cEt | 73 | 181 |
| 345785 | 67129 | 67148 | TGCCTCCTCCTTGGGAATGT | 5-10-5 | MOE | 50 | 182 |
| 481659 | 67129 | 67142 | CTCCTTGGGAATGT | 2-10-2 | cEt | 51 | 183 |
| 481435 | 67131 | 67146 | CCTCCTCCTTGGGAAT | 3-10-3 | cEt | 49 | 184 |
| 481660 | 67132 | 67145 | CTCCTCCTTGGGAA | 2-10-2 | cEt | 54 | 185 |
| 481436 | 67137 | 67152 | CGAATGCCTCCTCCTT | 3-10-3 | cEt | 82 | 186 |
| 481661 | 67138 | 67151 | GAATGCCTCCTCCT | 2-10-2 | cEt | 76 | 187 |
| 481437 | 67158 | 67173 | TCTCTGGCCGACAATA | 3-10-3 | cEt | 49 | 188 |
| 481662 | 67159 | 67172 | CTCTGGCCGACAAT | 2-10-2 | cEt | 43 | 189 |
| 481567 | 67194 | 67209 | AACAACTACCTGGGTC | 3-10-3 | cEt | 20 | 451 |
| 481792 | 67195 | 67208 | ACAACTACCTGGGT | 2-10-2 | cEt | 0 | 452 |
| 481438 | 72272 | 72287 | ACTTGGTCTTCAGGTA | 3-10-3 | cEt | 51 | 190 |
| 481663 | 72273 | 72286 | CTTGGTCTTCAGGT | 2-10-2 | cEt | 52 | 191 |
| 481568 | 72290 | 72305 | ACGGTGTCACACAGAT | 3-10-3 | cEt | 85 | 453 |
| 481793 | 72291 | 72304 | CGGTGTCACACAGA | 2-10-2 | cEt | 93 | 454 |
| 481569 | 72430 | 72445 | AACACACAAGGTCACT | 3-10-3 | cEt | 62 | 455 |
| 481794 | 72431 | 72444 | ACACACAAGGTCAC | 2-10-2 | cEt | 81 | 456 |
| 481570 | 72438 | 72453 | GCTTTTTAAACACACA | 3-10-3 | cEt | 79 | 457 |
| 481795 | 72439 | 72452 | CTTTTTAAACACAC | 2-10-2 | cEt | 0 | 458 |
| 481571 | 72528 | 72543 | TGACAAGACACAATGG | 3-10-3 | cEt | 12 | 459 |
| 481796 | 72529 | 72542 | GACAAGACACAATG | 2-10-2 | cEt | 36 | 460 |
| 481440 | 72586 | 72601 | GTATTGCTGCAGGTCG | 3-10-3 | cEt | 79 | 194 |
| 481665 | 72587 | 72600 | TATTGCTGCAGGTC | 2-10-2 | cEt | 43 | 195 |

TABLE 2-continued

Inhibition of human STAT3 mRNA levels by cEt and MOE chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481441 | 72594 | 72609 | GGTCAATGGTATTGCT | 3-10-3 | cEt | 55 | 196 |
| 481666 | 72595 | 72608 | GTCAATGGTATTGC | 2-10-2 | cEt | 36 | 197 |
| 481442 | 72602 | 72617 | CATCGGCAGGTCAATG | 3-10-3 | cEt | 44 | 198 |
| 481667 | 72603 | 72616 | ATCGGCAGGTCAAT | 2-10-2 | cEt | 31 | 199 |
| 481443 | 72622 | 72637 | GAATCTAAAGTGCGGG | 3-10-3 | cEt | 78 | 200 |
| 481668 | 72623 | 72636 | AATCTAAAGTGCGG | 2-10-2 | cEt | 41 | 201 |
| 481444 | 72630 | 72645 | GCATCAATGAATCTAA | 3-10-3 | cEt | 66 | 202 |
| 481669 | 72631 | 72644 | CATCAATGAATCTA | 2-10-2 | cEt | 0 | 203 |
| 481445 | 72638 | 72653 | TCCAAACTGCATCAAT | 3-10-3 | cEt | 70 | 204 |
| 481670 | 72639 | 72652 | CCAAACTGCATCAA | 2-10-2 | cEt | 60 | 205 |
| 481446 | 72659 | 72674 | TTCAGCACCTTCACCA | 3-10-3 | cEt | 44 | 206 |
| 481671 | 72660 | 72673 | TCAGCACCTTCACC | 2-10-2 | cEt | 41 | 207 |
| 481447 | 72675 | 72690 | GCCCTCCTGCTGAGGG | 3-10-3 | cEt | 10 | 208 |
| 481672 | 72676 | 72689 | CCCTCCTGCTGAGG | 2-10-2 | cEt | 15 | 209 |
| 481572 | 72682 | 72697 | CCAAACTGCCCTCCTG | 3-10-3 | cEt | 51 | 461 |
| 481797 | 72683 | 72696 | CAAACTGCCCTCCT | 2-10-2 | cEt | 11 | 211 |
| 481573 | 73535 | 73550 | GGTCAGAAAAGCCAGA | 3-10-3 | cEt | 55 | 462 |
| 481798 | 73536 | 73549 | GTCAGAAAAGCCAG | 2-10-2 | cEt | 59 | 463 |
| 481449 | 73690 | 73705 | CCATGTCAAAGGTGAG | 3-10-3 | cEt | 77 | 213 |
| 481674 | 73691 | 73704 | CATGTCAAAGGTGA | 2-10-2 | cEt | 31 | 214 |
| 481450 | 73717 | 73732 | GGGAGGTAGCGCACTC | 3-10-3 | cEt | 53 | 215 |
| 481675 | 73718 | 73731 | GGAGGTAGCGCACT | 2-10-2 | cEt | 41 | 216 |
| 481451 | 73779 | 73794 | GAATGCAGGTAGGCGC | 3-10-3 | cEt | 55 | 217 |
| 481676 | 73780 | 73793 | AATGCAGGTAGGCG | 2-10-2 | cEt | 39 | 218 |
| 481452 | 73818 | 73833 | TTTCAGATGATCTGGG | 3-10-3 | cEt | 71 | 219 |
| 481677 | 73819 | 73832 | TTCAGATGATCTGG | 2-10-2 | cEt | 38 | 220 |
| 481574 | 73837 | 73852 | GGAACCACAAAGTTAG | 3-10-3 | cEt | 69 | 221 |
| 481799 | 73838 | 73851 | GAACCACAAAGTTA | 2-10-2 | cEt | 50 | 222 |
| 481453 | 73868 | 73883 | GATAGCAGAAGTAGGA | 3-10-3 | cEt | 92 | 223 |
| 481678 | 73869 | 73882 | ATAGCAGAAGTAGG | 2-10-2 | cEt | 78 | 224 |
| 481454 | 73889 | 73904 | AAAGTGCCCAGATTGC | 3-10-3 | cEt | 85 | 225 |
| 481679 | 73890 | 73903 | AAGTGCCCAGATTG | 2-10-2 | cEt | 69 | 226 |
| 481455 | 73909 | 73924 | CACTCATTTCTCTATT | 3-10-3 | cEt | 74 | 227 |
| 481680 | 73910 | 73923 | ACTCATTTCTCTAT | 2-10-2 | cEt | 39 | 228 |
| 481456 | 73954 | 73969 | AACACATCCTTATTTG | 3-10-3 | cEt | 48 | 229 |
| 481681 | 73955 | 73968 | ACACATCCTTATTT | 2-10-2 | cEt | 47 | 230 |
| 481457 | 73966 | 73981 | TGGGTCTCAGAGAACA | 3-10-3 | cEt | 88 | 231 |

TABLE 2-continued

Inhibition of human STAT3 mRNA levels by cEt and MOE chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481682 | 73967 | 73980 | GGGTCTCAGAGAAC | 2-10-2 | cEt | 77 | 232 |
| 481458 | 74019 | 74034 | CAAGACATTTCCTTTT | 3-10-3 | cEt | 54 | 233 |
| 481683 | 74020 | 74033 | AAGACATTTCCTTT | 2-10-2 | cEt | 29 | 234 |
| 481459 | 74095 | 74110 | GGAGGCACTTGTCTAA | 3-10-3 | cEt | 76 | 235 |
| 481684 | 74096 | 74109 | GAGGCACTTGTCTA | 2-10-2 | cEt | 89 | 236 |
| 481460 | 74130 | 74145 | TTACAGAAACAGGCAG | 3-10-3 | cEt | 83 | 237 |
| 481685 | 74131 | 74144 | TACAGAAACAGGCA | 2-10-2 | cEt | 36 | 238 |
| 481461 | 74156 | 74171 | AGCTATAGGTGGCCTG | 3-10-3 | cEt | 75 | 239 |
| 481686 | 74157 | 74170 | GCTATAGGTGGCCT | 2-10-2 | cEt | 70 | 240 |
| 481462 | 74171 | 74186 | ATGCCAGGAGTATGTA | 3-10-3 | cEt | 89 | 241 |
| 481687 | 74172 | 74185 | TGCCAGGAGTATGT | 2-10-2 | cEt | 80 | 242 |
| 481463 | 74188 | 74203 | CAAGGTTAAAAAGTGC | 3-10-3 | cEt | 88 | 243 |
| 481688 | 74189 | 74202 | AAGGTTAAAAAGTG | 2-10-2 | cEt | 13 | 244 |
| 481464 | 74203 | 74218 | CTATTTGGATGTCAGC | 3-10-3 | cEt | 97 | 245 |
| 481689 | 74204 | 74217 | TATTTGGATGTCAG | 2-10-2 | cEt | 40 | 246 |
| 481465 | 74219 | 74234 | TAGATAGTCCTATCTT | 3-10-3 | cEt | 51 | 247 |
| 481690 | 74220 | 74233 | AGATAGTCCTATCT | 2-10-2 | cEt | 64 | 248 |
| 481466 | 74234 | 74249 | AAGAAACCTAGGGCTT | 3-10-3 | cEt | 74 | 249 |
| 481691 | 74235 | 74248 | AGAAACCTAGGGCT | 2-10-2 | cEt | 77 | 250 |
| 481467 | 74284 | 74299 | GCTGATACAGTGTTTT | 3-10-3 | cEt | 74 | 251 |
| 481692 | 74285 | 74298 | CTGATACAGTGTTT | 2-10-2 | cEt | 74 | 252 |
| 481468 | 74299 | 74314 | ATACAGAAAGGCTATG | 3-10-3 | cEt | 71 | 253 |
| 481693 | 74300 | 74313 | TACAGAAAGGCTAT | 2-10-2 | cEt | 25 | 254 |
| 481469 | 74314 | 74329 | GCTTAAGTTTCTTAAA | 3-10-3 | cEt | 61 | 255 |
| 481694 | 74315 | 74328 | CTTAAGTTTCTTAA | 2-10-2 | cEt | 0 | 256 |
| 481470 | 74648 | 74663 | AGCACCAAGGAGGCTG | 3-10-3 | cEt | 49 | 257 |
| 481695 | 74649 | 74662 | GCACCAAGGAGGCT | 2-10-2 | cEt | 83 | 258 |
| 481471 | 74663 | 74678 | AAGCTGAATGCTTAAA | 3-10-3 | cEt | 36 | 259 |
| 481696 | 74664 | 74677 | AGCTGAATGCTTAA | 2-10-2 | cEt | 33 | 260 |
| 481472 | 74678 | 74693 | TTACCAGCCTGAAGGA | 3-10-3 | cEt | 76 | 261 |
| 481697 | 74679 | 74692 | TACCAGCCTGAAGG | 2-10-2 | cEt | 63 | 262 |
| 481473 | 74693 | 74708 | CAGGGATTATATAAAT | 3-10-3 | cEt | 53 | 263 |
| 481698 | 74694 | 74707 | AGGGATTATATAAA | 2-10-2 | cEt | 15 | 264 |
| 481474 | 74708 | 74723 | ACCTGAAGCCCGTTTC | 3-10-3 | cEt | 80 | 265 |
| 481699 | 74709 | 74722 | CCTGAAGCCCGTTT | 2-10-2 | cEt | 57 | 266 |
| 481475 | 74723 | 74738 | TGTCTTAAGGGTTTGA | 3-10-3 | cEt | 93 | 267 |

TABLE 2-continued

Inhibition of human STAT3 mRNA levels by cEt and MOE chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481700 | 74724 | 74737 | GTCTTAAGGGTTTG | 2-10-2 | cEt | 89 | 268 |
| 481476 | 74738 | 74753 | GGTTGCAGCTTCAGAT | 3-10-3 | cEt | 92 | 269 |
| 481701 | 74739 | 74752 | GTTGCAGCTTCAGA | 2-10-2 | cEt | 60 | 270 |
| 481477 | 74754 | 74769 | TCAACACCAAAGGCCA | 3-10-3 | cEt | 95 | 271 |
| 481702 | 74755 | 74768 | CAACACCAAAGGCC | 2-10-2 | cEt | 89 | 272 |
| 481478 | 74772 | 74787 | TCCTTAAACCTTCCTA | 3-10-3 | cEt | 84 | 273 |
| 481703 | 74773 | 74786 | CCTTAAACCTTCCT | 2-10-2 | cEt | 57 | 274 |
| 481479 | 74787 | 74802 | AAAATGCTTAGATTCT | 3-10-3 | cEt | 80 | 275 |
| 481704 | 74788 | 74801 | AAATGCTTAGATTC | 2-10-2 | cEt | 32 | 276 |
| 481480 | 74815 | 74830 | AAATAAGTCTATTTAT | 3-10-3 | cEt | 5 | 277 |
| 481705 | 74816 | 74829 | AATAAGTCTATTTA | 2-10-2 | cEt | 25 | 278 |
| 481481 | 74835 | 74850 | GGCCAATACATTACAA | 3-10-3 | cEt | 63 | 279 |
| 481706 | 74836 | 74849 | GCCAATACATTACA | 2-10-2 | cEt | 56 | 280 |
| 481482 | 74857 | 74872 | TGCCCAGCCTTACTCA | 3-10-3 | cEt | 55 | 281 |
| 481707 | 74858 | 74871 | GCCCAGCCTTACTC | 2-10-2 | cEt | 43 | 282 |
| 481483 | 74872 | 74887 | GTTGTAAGCACCCTCT | 3-10-3 | cEt | 1 | 283 |
| 481708 | 74873 | 74886 | TTGTAAGCACCCTC | 2-10-2 | cEt | 56 | 284 |
| 481484 | 74887 | 74902 | AGAAAGGGAGTCAAGG | 3-10-3 | cEt | 60 | 285 |
| 481709 | 74888 | 74901 | GAAAGGGAGTCAAG | 2-10-2 | cEt | 27 | 286 |
| 481485 | 74904 | 74919 | GCAGATCAAGTCCAGG | 3-10-3 | cEt | 90 | 287 |
| 481710 | 74905 | 74918 | CAGATCAAGTCCAG | 2-10-2 | cEt | 88 | 288 |
| 481486 | 74917 | 74932 | AGCCTCTGAAACAGCA | 3-10-3 | cEt | 75 | 289 |
| 481711 | 74918 | 74931 | GCCTCTGAAACAGC | 2-10-2 | cEt | 74 | 290 |
| 481487 | 74933 | 74948 | CCCACAGAAACAACCT | 3-10-3 | cEt | 66 | 291 |
| 481712 | 74934 | 74947 | CCACAGAAACAACC | 2-10-2 | cEt | 45 | 292 |
| 481488 | 74948 | 74963 | AGCCCTGATAAGGCAC | 3-10-3 | cEt | 23 | 293 |
| 481713 | 74949 | 74962 | GCCCTGATAAGGCA | 2-10-2 | cEt | 18 | 294 |
| 481489 | 74963 | 74978 | AATCAGAAGTATCCCA | 3-10-3 | cEt | 60 | 295 |
| 481714 | 74964 | 74977 | ATCAGAAGTATCCC | 2-10-2 | cEt | 43 | 296 |
| 481490 | 75020 | 75035 | GCCTCTAGCAGGATCA | 3-10-3 | cEt | 78 | 297 |
| 481715 | 75021 | 75034 | CCTCTAGCAGGATC | 2-10-2 | cEt | 79 | 298 |
| 481491 | 75035 | 75050 | CACGCAAGGAGACATG | 3-10-3 | cEt | 70 | 299 |
| 481716 | 75036 | 75049 | ACGCAAGGAGACAT | 2-10-2 | cEt | 68 | 300 |
| 481492 | 75050 | 75065 | TGAGGGACCTTTAGAC | 3-10-3 | cEt | 61 | 301 |
| 481717 | 75051 | 75064 | GAGGGACCTTTAGA | 2-10-2 | cEt | 44 | 302 |
| 481493 | 75073 | 75088 | CAGGATTCCTAAAACA | 3-10-3 | cEt | 43 | 303 |
| 481718 | 75074 | 75087 | AGGATTCCTAAAAC | 2-10-2 | cEt | 7 | 304 |

TABLE 2-continued

Inhibition of human STAT3 mRNA levels by cEt and MOE chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481494 | 75088 | 75103 | ATGAGGTCCTGAGACC | 3-10-3 | cEt | 60 | 305 |
| 481719 | 75089 | 75102 | TGAGGTCCTGAGAC | 2-10-2 | cEt | 29 | 306 |
| 481495 | 75127 | 75142 | CATCATGTCCAACCTG | 3-10-3 | cEt | 92 | 307 |
| 481720 | 75128 | 75141 | ATCATGTCCAACCT | 2-10-2 | cEt | 63 | 308 |
| 481496 | 75142 | 75157 | GGGCCCCATAGTGTGC | 3-10-3 | cEt | 29 | 309 |
| 481721 | 75143 | 75156 | GGCCCCATAGTGTG | 2-10-2 | cEt | 19 | 310 |
| 481497 | 75164 | 75179 | AGCTCAACCAGACACG | 3-10-3 | cEt | 67 | 311 |
| 481722 | 75165 | 75178 | GCTCAACCAGACAC | 2-10-2 | cEt | 69 | 312 |
| 481498 | 75179 | 75194 | GAACCATATTCCCTGA | 3-10-3 | cEt | 90 | 313 |
| 481723 | 75180 | 75193 | AACCATATTCCCTG | 2-10-2 | cEt | 49 | 314 |
| 481499 | 75194 | 75209 | CAAGAAACTGGCTAAG | 3-10-3 | cEt | 43 | 315 |
| 481724 | 75195 | 75208 | AAGAAACTGGCTAA | 2-10-2 | cEt | 17 | 316 |
| 481500 | 75209 | 75224 | GCCACTGGATATCACC | 3-10-3 | cEt | 92 | 317 |
| 481725 | 75210 | 75223 | CCACTGGATATCAC | 2-10-2 | cEt | 88 | 464 |
| 481501 | 75235 | 75250 | AACTGAATGAAGACGC | 3-10-3 | cEt | 91 | 318 |
| 481726 | 75236 | 75249 | ACTGAATGAAGACG | 2-10-2 | cEt | 56 | 319 |
| 481502 | 75250 | 75265 | CCTTTGCCCTGCATGA | 3-10-3 | cEt | 85 | 320 |
| 481727 | 75251 | 75264 | CTTTGCCCTGCATG | 2-10-2 | cEt | 70 | 321 |
| 481503 | 75265 | 75280 | AAGTTTATCAGTAAGC | 3-10-3 | cEt | 57 | 322 |
| 481728 | 75266 | 75279 | AGTTTATCAGTAAG | 2-10-2 | cEt | 22 | 323 |
| 481504 | 75280 | 75295 | TACGAGGGCAGACTCA | 3-10-3 | cEt | 60 | 324 |
| 481729 | 75281 | 75294 | ACGAGGGCAGACTC | 2-10-2 | cEt | 22 | 325 |
| 481505 | 75295 | 75310 | AGGTATACACCCTCAT | 3-10-3 | cEt | 45 | 326 |
| 481730 | 75296 | 75309 | GGTATACACCCTCA | 2-10-2 | cEt | 47 | 327 |
| 481506 | 75310 | 75325 | CCTCAGAGGGAGGCCA | 3-10-3 | cEt | 32 | 328 |
| 481731 | 75311 | 75324 | CTCAGAGGGAGGCC | 2-10-2 | cEt | 0 | 329 |
| 481507 | 75325 | 75340 | GGGAGGAGTCACCAGC | 3-10-3 | cEt | 64 | 330 |
| 481732 | 75326 | 75339 | GGAGGAGTCACCAG | 2-10-2 | cEt | 59 | 331 |
| 481508 | 75392 | 75407 | TAGCCAGCCAAGGCGG | 3-10-3 | cEt | 33 | 332 |
| 481733 | 75393 | 75406 | AGCCAGCCAAGGCG | 2-10-2 | cEt | 50 | 333 |
| 481509 | 75407 | 75422 | ACAGGAGAGGCGAGCT | 3-10-3 | cEt | 46 | 334 |
| 481734 | 75408 | 75421 | CAGGAGAGGCGAGC | 2-10-2 | cEt | 28 | 335 |
| 481510 | 75424 | 75439 | TAGGTGTTCCCATACG | 3-10-3 | cEt | 95 | 336 |
| 481735 | 75425 | 75438 | AGGTGTTCCCATAC | 2-10-2 | cEt | 22 | 337 |
| 481511 | 75445 | 75460 | GGCAGCCCATCCAGCA | 3-10-3 | cEt | 43 | 338 |
| 481736 | 75446 | 75459 | GCAGCCCATCCAGC | 2-10-2 | cEt | 54 | 339 |

TABLE 2-continued

Inhibition of human STAT3 mRNA levels by cEt and MOE chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481512 | 75462 | 75477 | CATGCCTCTGAGTCAG | 3-10-3 | cEt | 30 | 340 |
| 481737 | 75463 | 75476 | ATGCCTCTGAGTCA | 2-10-2 | cEt | 31 | 341 |
| 481513 | 75477 | 75492 | GTTGCCAAATCCGGCC | 3-10-3 | cEt | 85 | 342 |
| 481738 | 75478 | 75491 | TTGCCAAATCCGGC | 2-10-2 | cEt | 70 | 343 |
| 481514 | 75492 | 75507 | GCAAGGTGGTTTTGAG | 3-10-3 | cEt | 85 | 344 |
| 481739 | 75493 | 75506 | CAAGGTGGTTTTGA | 2-10-2 | cEt | 60 | 345 |
| 481515 | 75512 | 75527 | AGAAACTCTGATCAGC | 3-10-3 | cEt | 88 | 346 |
| 481740 | 75513 | 75526 | GAAACTCTGATCAG | 2-10-2 | cEt | 71 | 347 |
| 481516 | 75551 | 75566 | CAGAGACCAGCTAATT | 3-10-3 | cEt | 78 | 348 |
| 481741 | 75552 | 75565 | AGAGACCAGCTAAT | 2-10-2 | cEt | 80 | 349 |
| 481517 | 75581 | 75596 | ATCTTAGAGAAGGTCG | 3-10-3 | cEt | 87 | 350 |
| 481742 | 75582 | 75595 | TCTTAGAGAAGGTC | 2-10-2 | cEt | 64 | 351 |
| 481518 | 75612 | 75627 | CCAGGCAGGAGGACTG | 3-10-3 | cEt | 67 | 352 |
| 481743 | 75613 | 75626 | CAGGCAGGAGGACT | 2-10-2 | cEt | 75 | 353 |
| 481519 | 75624 | 75639 | CATCAACTGTCTCCAG | 3-10-3 | cEt | 29 | 354 |
| 481744 | 75625 | 75638 | ATCAACTGTCTCCA | 2-10-2 | cEt | 69 | 355 |
| 481520 | 75626 | 75641 | CACATCAACTGTCTCC | 3-10-3 | cEt | 73 | 356 |
| 481745 | 75627 | 75640 | ACATCAACTGTCTC | 2-10-2 | cEt | 74 | 357 |
| 481521 | 75646 | 75661 | GAAGTAAGAGCTCTGC | 3-10-3 | cEt | 86 | 358 |
| 481746 | 75647 | 75660 | AAGTAAGAGCTCTG | 2-10-2 | cEt | 67 | 359 |
| 481522 | 75661 | 75676 | AAGAGTGTTGCTGGAG | 3-10-3 | cEt | 92 | 360 |
| 481747 | 75662 | 75675 | AGAGTGTTGCTGGA | 2-10-2 | cEt | 95 | 361 |
| 481523 | 75676 | 75691 | GCTTATTATGTACTGA | 3-10-3 | cEt | 95 | 362 |
| 481748 | 75677 | 75690 | CTTATTATGTACTG | 2-10-2 | cEt | 15 | 363 |
| 481524 | 75717 | 75732 | GCCCAAGTCTCACCTT | 3-10-3 | cEt | 70 | 364 |
| 481749 | 75718 | 75731 | CCCAAGTCTCACCT | 2-10-2 | cEt | 70 | 365 |
| 481525 | 75728 | 75743 | CCCAATGGTAAGCCCA | 3-10-3 | cEt | 93 | 366 |
| 481750 | 75729 | 75742 | CCAATGGTAAGCCC | 2-10-2 | cEt | 94 | 367 |
| 481526 | 75730 | 75745 | AACCCAATGGTAAGCC | 3-10-3 | cEt | 82 | 368 |
| 481751 | 75731 | 75744 | ACCCAATGGTAAGC | 2-10-2 | cEt | 54 | 369 |
| 481527 | 75747 | 75762 | TAGGTCCCTATGATTT | 3-10-3 | cEt | 55 | 370 |
| 481752 | 75748 | 75761 | AGGTCCCTATGATT | 2-10-2 | cEt | 62 | 371 |
| 481528 | 75766 | 75781 | AAGCCCTGAACCCTCG | 3-10-3 | cEt | 77 | 372 |
| 481753 | 75767 | 75780 | AGCCCTGAACCCTC | 2-10-2 | cEt | 71 | 373 |
| 481529 | 75802 | 75817 | CCTAAGGCCATGAACT | 3-10-3 | cEt | 64 | 374 |
| 481754 | 75803 | 75816 | CTAAGGCCATGAAC | 2-10-2 | cEt | 53 | 375 |
| 481530 | 75817 | 75832 | ACCAGATACATGCTAC | 3-10-3 | cEt | 87 | 376 |

TABLE 2-continued

Inhibition of human STAT3 mRNA levels by cEt and MOE chimeric antisense oligonucleotides targeted to SEQ ID NO: 2

| ISIS NO | Human Start Site | Human Stop Site | Sequence | Motif | Wing Chem | % inhibition | SEQ ID NO |
|---|---|---|---|---|---|---|---|
| 481755 | 75818 | 75831 | CCAGATACATGCTA | 2-10-2 | cEt | 84 | 377 |
| 481531 | 75833 | 75848 | TACAATCAGAGTTAAG | 3-10-3 | cEt | 66 | 378 |
| 481756 | 75834 | 75847 | ACAATCAGAGTTAA | 2-10-2 | cEt | 5 | 379 |
| 481532 | 75851 | 75866 | TCCTCTCAGAACTTTT | 3-10-3 | cEt | 65 | 380 |
| 481757 | 75852 | 75865 | CCTCTCAGAACTTT | 2-10-2 | cEt | 81 | 381 |
| 481533 | 75853 | 75868 | GCTCCTCTCAGAACTT | 3-10-3 | cEt | 80 | 382 |
| 481758 | 75854 | 75867 | CTCCTCTCAGAACT | 2-10-2 | cEt | 62 | 383 |
| 481534 | 75880 | 75895 | TTCTTTAATGGGCCAC | 3-10-3 | cEt | 79 | 384 |
| 481759 | 75881 | 75894 | TCTTTAATGGGCCA | 2-10-2 | cEt | 74 | 385 |
| 481535 | 75954 | 75969 | ACGGGATTCCCTCGGC | 3-10-3 | cEt | 78 | 386 |
| 481760 | 75955 | 75968 | CGGGATTCCCTCGG | 2-10-2 | cEt | 78 | 387 |
| 481536 | 75969 | 75984 | GTAGGTAAGCAACCCA | 3-10-3 | cEt | 91 | 388 |
| 481761 | 75970 | 75983 | TAGGTAAGCAACCC | 2-10-2 | cEt | 78 | 389 |
| 481537 | 76017 | 76032 | GAATTTGAATGCAGTG | 3-10-3 | cEt | 84 | 390 |
| 481762 | 76018 | 76031 | AATTTGAATGCAGT | 2-10-2 | cEt | 2 | 391 |
| 481538 | 76031 | 76046 | TGAAGTACACATTGGA | 3-10-3 | cEt | 92 | 392 |
| 481763 | 76032 | 76045 | GAAGTACACATTGG | 2-10-2 | cEt | 96 | 393 |
| 481539 | 76047 | 76062 | ATAAATTTTTACACTA | 3-10-3 | cEt | 19 | 394 |
| 481764 | 76048 | 76061 | TAAATTTTTACACT | 2-10-2 | cEt | 1 | 395 |
| 481765 | 76056 | 76069 | CAATAATATAAATT | 2-10-2 | cEt | 0 | 396 |
| 481541 | 76121 | 76136 | CTGGAAGTTAAAGTAG | 3-10-3 | cEt | 71 | 397 |
| 481766 | 76122 | 76135 | TGGAAGTTAAAGTA | 2-10-2 | cEt | 10 | 398 |

Example 2

Antisense Inhibition of Murine STAT3 in b.END Cells

Antisense oligonucleotides tested in the study described in Example 1 were also tested for their effects on STAT3 mRNA in b.END cells. Cultured b.END cells at a density of 20,000 cells per well were transfected using electroporation with 7,000 nM antisense oligonucleotide. After a treatment period of approximately 24 hours, RNA was isolated from the cells and STAT3 mRNA levels were measured by quantitative real-time PCR. Murine primer probe set RTS2381 (forward sequence GCCACGTTGGTGTTTCATAATCT, designated herein as SEQ ID NO: 465; reverse sequence GATAGAGGACATTGGACTCTTGCA, designated herein as SEQ ID NO: 466; probe sequence TTGGGTGAAAATTGACCAG-CAATATAGCCG, designated herein as SEQ ID NO: 467) was used to measure RNA. STAT3 mRNA levels were adjusted according to total RNA content, as measured by RIBOGREEN®.

Certain sequences complementary to the STAT3 mouse gene sequence showed good inhibition in b. END cells. Results are presented in Table 3 as percent inhibition of STAT3, relative to untreated control cells. The human oligonucleotides in Table 3 were compared to the mouse STAT-3 genomic sequence, designated herein as SEQ ID NO: 3 (the complement of GENBANK Accession No. NT_165773.2 truncated from nucleotides 12286001 to 12344000). "Mouse Target start site" indicates the 5'-most nucleotide to which the gapmer is targeted in the murine sequence. "Mouse Target stop site" indicates the 3'-most nucleotide to which the gapmer is targeted murine sequence.

TABLE 3

Inhibition of human STAT3 mRNA levels by certain cEt chimeric antisense oligonucleotides complementary to SEQ ID NO: 1 and SEQ ID NO: 3

| ISIS NO | Mouse Start Site | Mouse Stop Site | % inhibition | SEQ ID NO |
|---|---|---|---|---|
| 481549 | 5283 | 5298 | 96 | 413 |
| 481553 | 9913 | 9928 | 94 | 421 |
| 481768 | 3189 | 3202 | 91 | 402 |
| 481356 | 30356 | 30371 | 83 | 21 |
| 481548 | 4045 | 4060 | 82 | 411 |
| 481554 | 14662 | 14677 | 82 | 423 |
| 481426 | 48328 | 48343 | 82 | 165 |
| 481580 | 30333 | 30346 | 81 | 20 |
| 481412 | 47413 | 47428 | 81 | 135 |
| 481417 | 47636 | 47651 | 81 | 147 |
| 481418 | 47637 | 47652 | 80 | 148 |
| 481355 | 30332 | 30347 | 79 | 19 |
| 481396 | 43120 | 43135 | 79 | 443 |
| 481416 | 47634 | 47649 | 79 | 144 |
| 481420 | 47681 | 47696 | 79 | 153 |
| 481358 | 32842 | 32857 | 78 | 25 |
| 481363 | 33520 | 33535 | 78 | 35 |
| 481570 | 51870 | 51885 | 78 | 457 |
| 481382 | 37857 | 37872 | 77 | 74 |
| 481378 | 36560 | 36575 | 76 | 66 |
| 481431 | 48403 | 48418 | 76 | 175 |
| 481453 | 53034 | 53049 | 76 | 223 |
| 481621 | 43121 | 43134 | 75 | 444 |
| 481641 | 47635 | 47648 | 75 | 145 |
| 481637 | 47414 | 47427 | 74 | 136 |
| 481380 | 36631 | 36646 | 73 | 70 |
| 481574 | 53000 | 53015 | 73 | 221 |
| 481601 | 36392 | 36405 | 71 | 62 |
| 481419 | 47638 | 47653 | 71 | 150 |
| 481371 | 35938 | 35953 | 70 | 51 |
| 481642 | 47637 | 47650 | 70 | 149 |
| 481542 | 3180 | 3195 | 69 | 399 |
| 481547 | 3313 | 3328 | 69 | 409 |
| 481772 | 3314 | 3327 | 69 | 410 |
| 481362 | 32929 | 32944 | 69 | 33 |
| 481653 | 48362 | 48375 | 69 | 170 |
| 481786 | 38812 | 38825 | 68 | 440 |
| 481415 | 47629 | 47644 | 68 | 141 |
| 481543 | 3188 | 3203 | 67 | 401 |
| 481793 | 51714 | 51727 | 67 | 454 |
| 481443 | 52060 | 52075 | 67 | 200 |
| 481684 | 53229 | 53242 | 67 | 236 |
| 481398 | 45226 | 45241 | 66 | 106 |
| 481560 | 36394 | 36409 | 65 | 438 |
| 481643 | 47638 | 47651 | 65 | 151 |
| 481430 | 48387 | 48402 | 65 | 173 |
| 481440 | 52024 | 52039 | 65 | 194 |

Example 3

Tolerability of Antisense Oligonucleotides Targeting STAT3 in BALB/c Mice

Forty antisense oligonucleotides exhibiting a high level of potency, selected from among the 452 compounds evaluated in Example 1, were further tested for in vivo tolerability.

Groups of 2-4 male BALB/c mice were injected subcutaneously twice a week for 3 weeks with 25 mg/kg of ISIS antisense oligonucleotides. One group of 4 male BALB/c mice was injected subcutaneously twice a week for 3 weeks with PBS. This group of mice was utilized as a control group to which the treatment groups were compared. One day after the last dose, body weights were taken, mice were euthanized, and organs and plasma were harvested for further analysis.

The body weights of the mice were measured pre-dose and at the end of the treatment period. Percent increase over the initial body weight was calculated. Liver, spleen, and kidney weights were measured at the end of the study and were compared to PBS treated mice.

To evaluate the effect of ISIS oligonucleotides on metabolic function, plasma concentrations of transaminases and BUN were measured using an automated clinical chemistry analyzer (Hitachi Olympus AU400e, Melville, N.Y.). Plasma concentrations of ALT (alanine transaminase), AST (aspartate transaminase), and BUN were measured.

Among the forty antisense oligonucleotides tested, certain antisense oligonucleotides, including ISIS 481374, ISIS 481390, ISIS 481420, ISIS 481431, ISIS 481453, ISIS 481464, ISIS 481475, ISIS 481495, ISIS 481500, ISIS 481501, ISIS 481525, ISIS 481548, ISIS 481549, ISIS 481597, ISIS 481695, ISIS 481700, ISIS 481702, ISIS 481710, ISIS 481725, ISIS 481750, and ISIS 481763 met tolerability thresholds for body weight, organ weight, ALT, AST, and BUN parameters.

Example 4

Dose-Dependent Antisense Inhibition of Human STAT3 in HuVEC Cells

Gapmers from Examples 1 and 2 exhibiting significant in vitro inhibition of STAT3 were tested at various doses in HuVEC cells. Cells were plated at a density of 20,000 cells per well and transfected using electroporation with 31.25 nM, 62.5 nM, 125 nM, 250 nM, 500 nM, and 1,0000 nM concentrations of antisense oligonucleotide, as specified in Table 4. After a treatment period of approximately 16 hours, RNA was isolated from the cells and STAT3 mRNA levels were measured by quantitative real-time PCR. Human STAT3 primer probe set RTS199 (forward sequence ACATGCCACTTTG-GTGTTTCATAA, designated herein as SEQ ID NO: 6; reverse sequence TCTTCGTAGATTGTGCTGATA-GAGAAC, designated herein as SEQ ID NO: 7; probe sequence CAGTATAGCCGCTTCCTGCAAGAGTCGAA, designated herein as SEQ ID NO: 8) was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 4 and was calculated by plotting the concentrations of oligonucleotides used versus the percent inhibition of STAT3 mRNA expression achieved at each concentration and noting the concentration of oligonucleotide at which 50% inhibition of STAT3 mRNA expression was achieved compared to the control. As illustrated in Table 4, STAT3 mRNA levels were significantly reduced in a dose-dependent manner in antisense oligonucleotide treated cells.

TABLE 4

Dose-dependent antisense inhibition of human STAT3 in HuVEC cells using electroporation

| ISIS No | 31.25 nM | 62.5 nM | 125.0 nM | 250.0 nM | 500.0 nM | 1000.0 nM | $IC_{50}$ (µM) |
|---|---|---|---|---|---|---|---|
| 481355 | 19 | 15 | 36 | 61 | 75 | 89 | 0.18 |
| 481374 | 25 | 42 | 52 | 72 | 82 | 88 | 0.10 |
| 481390 | 17 | 37 | 44 | 60 | 73 | 86 | 0.15 |
| 481420 | 23 | 20 | 40 | 60 | 81 | 92 | 0.16 |
| 481453 | 21 | 37 | 52 | 69 | 79 | 88 | 0.12 |
| 481464 | 57 | 73 | 81 | 90 | 94 | 94 | <0.03 |

TABLE 4-continued

Dose-dependent antisense inhibition of human
STAT3 in HuVEC cells using electroporation

| ISIS No | 31.25 nM | 62.5 nM | 125.0 nM | 250.0 nM | 500.0 nM | 1000.0 nM | $IC_{50}$ (µM) |
|---|---|---|---|---|---|---|---|
| 481475 | 22 | 46 | 54 | 78 | 83 | 92 | 0.10 |
| 481500 | 25 | 37 | 42 | 75 | 83 | 90 | 0.12 |
| 481501 | 32 | 57 | 69 | 82 | 94 | 94 | 0.05 |
| 481523 | 35 | 60 | 74 | 85 | 90 | 93 | 0.04 |
| 481525 | 36 | 53 | 60 | 79 | 89 | 92 | 0.06 |
| 481549 | 0 | 16 | 60 | 81 | 90 | 96 | 0.15 |
| 481554 | 0 | 15 | 28 | 49 | 70 | 86 | 0.25 |
| 481597 | 8 | 18 | 39 | 48 | 64 | 83 | 0.24 |
| 481695 | 15 | 27 | 39 | 50 | 64 | 80 | 0.22 |
| 481700 | 0 | 17 | 44 | 58 | 80 | 88 | 0.20 |
| 481710 | 12 | 39 | 65 | 79 | 86 | 90 | 0.11 |
| 481715 | 11 | 26 | 32 | 44 | 53 | 69 | 0.36 |
| 481725 | 27 | 40 | 56 | 77 | 89 | 93 | 0.09 |
| 481750 | 7 | 24 | 46 | 63 | 83 | 89 | 0.16 |
| 481755 | 17 | 28 | 30 | 54 | 68 | 80 | 0.20 |
| 481768 | 7 | 21 | 27 | 44 | 67 | 85 | 0.26 |

Example 5

Dose-Dependent Antisense Inhibition of STAT3
Following Free Uptake of Antisense Oligonucleotide
in SK-BR-3 Cells Gapmers from Example 4 were tested at various doses in SK-BR-3 cells. Cells were plated at a density of 4,000 cells per well. Cells were incubated with 0.02 µM, 0.1 µM, 0.5 µM, 1 µM, 2.5 and 10 µM concentrations of antisense oligonucleotide, as specified in Table 5. After approximately 24 hours, RNA was isolated from the cells and STAT3 mRNA levels were measured by quantitative real-time PCR. Human STAT3 primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 5. As illustrated in Table 5, most of the ISIS oligonucleotides were able to penetrate the cell membrane and STAT3 mRNA levels were significantly reduced in a dose-dependent manner in antisense oligonucleotide treated cells.

TABLE 5

Dose-dependent antisense inhibition of human STAT3 by
free-uptake of ISIS oligonucleotide by SK-BR-3 cells

| ISIS No | 0.02 µM | 0.1 µM | 0.5 µM | 1 µM | 2.5 µM | 10 µM | $IC_{50}$ (µM) |
|---|---|---|---|---|---|---|---|
| 481374 | 10 | 18 | 18 | 16 | 8 | 25 | 15.9 |
| 481390 | 0 | 10 | 11 | 12 | 40 | 72 | 3.2 |
| 481453 | 14 | 13 | 27 | 45 | 58 | 79 | 1.3 |
| 481464 | 23 | 32 | 57 | 70 | 85 | 93 | 0.5 |
| 481475 | 0 | 0 | 35 | 49 | 72 | 88 | 1.0 |
| 481500 | 7 | 9 | 26 | 45 | 49 | 75 | 1.7 |
| 481501 | 0 | 0 | 4 | 5 | 53 | 65 | 2.7 |
| 481523 | 9 | 24 | 56 | 67 | 83 | 92 | 0.5 |
| 481525 | 0 | 17 | 13 | 15 | 32 | 68 | 4.4 |
| 481549 | 0 | 0 | 0 | 16 | 33 | 54 | 8.2 |
| 481597 | 1 | 0 | 11 | 14 | 22 | 44 | 10.6 |
| 481710 | 5 | 0 | 10 | 13 | 27 | 66 | 6.0 |
| 481725 | 29 | 45 | 47 | 39 | 39 | 63 | 2.6 |
| 481750 | 19 | 24 | 36 | 42 | 71 | 80 | 1.1 |
| 481763 | 30 | 38 | 51 | 63 | 81 | 89 | 0.6 |
| 481768 | 12 | 5 | 34 | 25 | 32 | 35 | 12.4 |

Example 6

Dose-Dependent Antisense Inhibition of STAT3
Following Free Uptake of Antisense Oligonucleotide
in U251-MG Cells Gapmers from Example 5 were further tested at various doses in U251-MG cells. Cells were plated at a density of 4,000 cells per well. Cells were incubated with 0.02 µM, 0.1 µM, 0.5 µM, 1 µM, 2.5 µM, and 10 µM concentrations of antisense oligonucleotide, as specified in Table 6. After approximately 24 hours, RNA was isolated from the cells and STAT3 mRNA levels were measured by quantitative real-time PCR. Human STAT3 primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 6. As illustrated in Table 6, most of the ISIS oligonucleotides were able to penetrate the cell membrane and STAT3 mRNA levels were significantly reduced in a dose-dependent manner in antisense oligonucleotide treated cells.

TABLE 6

Dose-dependent antisense inhibition of STAT3 mRNA levels
by free-uptake of ISIS oligonucleotide by U251-MG cells

| ISIS No | 0.02 µM | 0.1 µM | 0.5 µM | 1 µM | 2.5 µM | 10 µM | $IC_{50}$ (µM) |
|---|---|---|---|---|---|---|---|
| 481374 | 0 | 0 | 10 | 0 | 12 | 25 | 15.7 |
| 481390 | 0 | 4 | 10 | 8 | 16 | 31 | 13.9 |
| 481453 | 4 | 3 | 15 | 16 | 20 | 42 | 11.0 |
| 481464 | 13 | 11 | 41 | 42 | 54 | 79 | 1.3 |
| 481475 | 3 | 13 | 26 | 37 | 41 | 67 | 2.6 |
| 481500 | 2 | 12 | 14 | 12 | 25 | 38 | 11.7 |
| 481501 | 0 | 0 | 2 | 1 | 14 | 47 | 10.3 |
| 481523 | 22 | 27 | 39 | 45 | 63 | 83 | 1.1 |
| 481525 | 1 | 1 | 17 | 17 | 35 | 60 | 6.3 |
| 481549 | 0 | 0 | 0 | 0 | 9 | 29 | 14.5 |
| 481597 | 3 | 3 | 12 | 18 | 18 | 47 | 10.1 |
| 481695 | 0 | 14 | 12 | 22 | 25 | 33 | 12.9 |
| 481710 | 0 | 0 | 0 | 0 | 6 | 23 | 16.8 |
| 481725 | 0 | 0 | 5 | 7 | 20 | 38 | 11.8 |
| 481750 | 4 | 15 | 18 | 18 | 17 | 33 | 13.2 |
| 481763 | 15 | 16 | 25 | 36 | 36 | 64 | 3.2 |
| 481768 | 22 | 16 | 18 | 22 | 21 | 37 | 12.2 |

Example 7

Dose-Dependent Antisense Inhibition of STAT3
Following Free Uptake of Antisense Oligonucleotide
in U251-MG Cells ISIS 481464 and ISIS 481549, from the studies described above, were further tested at different doses in U251-MG cells. Cells were plated at a density of 4,000 cells per well. Cells were incubated with 0.1 µM, 1 µM, 5 µM, and 20 µM concentrations of antisense oligonucleotide, as specified in Table 7. After approximately 24 hours, RNA was isolated from the cells and STAT3 mRNA levels were measured by quantitative real-time PCR. Human STAT3 primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 7. As illustrated in Table 7, both the ISIS oligonucleotides were able to penetrate the cell membrane.

TABLE 7

Dose-dependent antisense inhibition of STAT3 mRNA levels by free-uptake of ISIS oligonucleotide by U251-MG cells

| ISIS No | 0.1 µM | 1 µM | 5 µM | 10 µM | 20 µM | $IC_{50}$ (µM) |
|---|---|---|---|---|---|---|
| 481464 | 0 | 30 | 69 | 80 | 79 | 2.3 |
| 481549 | 0 | 0 | 26 | 35 | 38 | >20 |

Example 8

Dose-Dependent Antisense Inhibition of STAT3 Following Free Uptake of Antisense Oligonucleotide in MDA-MB-231 Cells ISIS 481464 and ISIS 481549 were further tested at different doses in MDA-MB-231 cells. Cells were plated at a density of 4,000 cells per well. Cells were incubated with 0.02 µM, 0.2 µM, 1.0 µM, 5.0 µM, and 10.0 µM concentrations of antisense oligonucleotide, as specified in Table 8. After approximately 24 hours, RNA was isolated from the cells and STAT3 mRNA levels were measured by quantitative real-time PCR. Human STAT3 primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 8. As illustrated in Table 8, both the ISIS oligonucleotides were able to penetrate the cell membrane and significantly reduce STAT3 mRNA levels in a dose-dependent manner.

TABLE 8

Dose-dependent antisense inhibition of STAT3 mRNA levels by free-uptake of ISIS oligonucleotide by MDA-MB-231 cells

| ISIS No | 0.02 µM | 0.2 µM | 1.0 µM | 5.0 µM | 10.0 µM | $IC_{50}$ (µM) |
|---|---|---|---|---|---|---|
| 481464 | 0 | 25 | 71 | 85 | 87 | 0.6 |
| 481549 | 0 | 2 | 33 | 49 | 66 | 4.4 |

Example 9

Dose-Dependent Antisense Inhibition of STAT3 Following Free Uptake of Antisense Oligonucleotide in A431 Cells ISIS 481464 and ISIS 481549 were further tested at different doses in A431 cells. Cells were plated at a density of 4,000 cells per well. Cells were incubated with 0.02 µM, 0.2 µM, 1.0 µM, 5.0 µM and 10.0 µM concentrations of antisense oligonucleotide, as specified in Table 9. After approximately 24 hours, RNA was isolated from the cells and STAT3 mRNA levels were measured by quantitative real-time PCR. Human STAT3 primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 9. As illustrated in Table 9, both the ISIS oligonucleotides were able to penetrate the cell membrane and significantly reduce STAT3 mRNA levels in a dose-dependent manner.

TABLE 9

Dose-dependent antisense inhibition of STAT3 mRNA levels by free-uptake of ISIS oligonucleotide by A431 cells

| ISIS No | 0.02 µM | 0.2 µM | 1.0 µM | 5.0 µM | 10.0 µM | $IC_{50}$ (µM) |
|---|---|---|---|---|---|---|
| 481464 | 79 | 93 | 98 | 98 | 98 | <0.02 |
| 481549 | 0 | 38 | 68 | 82 | 84 | 0.6 |

Example 10

Dose-Dependent Antisense Inhibition of STAT3 Following Free Uptake of Antisense Oligonucleotide in 11460 Cells ISIS 481464 and ISIS 481549 were further tested at different doses in 11460 cells. Cells were plated at a density of 4,000 cells per well. Cells were incubated with 0.02 µM, 0.2 µM, 1.0 µM, 5.0 µM, and 10.0 µM concentrations of antisense oligonucleotide, as specified in Table 10. After approximately 24 hours, RNA was isolated from the cells and STAT3 mRNA levels were measured by quantitative real-time PCR. Human STAT3 primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 10. As illustrated in Table 10, both the ISIS oligonucleotides were able to penetrate the cell membrane and significantly reduce STAT3 mRNA levels in a dose-dependent manner.

TABLE 10

Dose-dependent antisense inhibition of STAT3 mRNA levels by free-uptake of ISIS oligonucleotide by H460 cells

| ISIS No | 0.02 µM | 0.2 µM | 1.0 µM | 5.0 µM | 10.0 µM | $IC_{50}$ (µM) |
|---|---|---|---|---|---|---|
| 481464 | 46 | 89 | 96 | 97 | 98 | 0.01 |
| 481549 | 8 | 53 | 78 | 96 | 98 | 0.23 |

Example 11

Antisense Inhibition of Human STAT3 in HuVEC Cells

Antisense oligonucleotides were designed targeting a human STAT3 nucleic acid and were tested for their effect on human STAT3 mRNA expression in vitro. Cultured HuVEC cells at a density of 20,000 cells per well were transfected using electroporation with 1,000 nM antisense oligonucleotide. After a treatment period of approximately 24 hours, RNA was isolated from the cells and STAT3 mRNA levels were measured by quantitative real-time PCR. Human primer probe set RTS199 (forward sequence ACATGCCACTTTG-GTGTTTCATAA, designated herein as SEQ ID NO: 6; reverse sequence TCTTCGTAGATTGTGCTGATA-GAGAAC, designated herein as SEQ ID NO: 7; probe sequence CAGTATAGCCGCTTCCTGCAAGAGTCGAA, designated herein as SEQ ID NO: 8) was used to measure mRNA levels. STAT3 mRNA levels were adjusted according to total RNA content, as measured by RIBOGREEN®. Results are presented as percent inhibition of STAT3, relative to untreated control cells.

The chimeric antisense oligonucleotides in Table 11 were designed as 3-10-3 MOE, deoxy, and cEt gapmers. The gapmers are 16 nucleotides in length, wherein the central gap segment comprises of ten 2'-deoxynucleosides and is flanked on both sides (in the 5' and 3' directions) by wings comprising three nucleosides each. Each nucleoside in the 5'-wing segment has a 2'-MOE sugar modification. Each nucleoside in the 3'-wing segment has a cEt sugar modification. The internucleoside linkages throughout each gapmer are phosphorothioate (P=S) linkages. All cytosine residues throughout each gapmer are 5'-methylcytosines. The chemistry column of Table 11 presents the sugar motif of each gapmer, wherein 'e' indicates a 2'-MOE nucleoside, 'k' indicates a constrained ethyl (cEt) nucleoside, and 'd' indicates a 2'-deoxynucleoside.

"Human Target start site" indicates the 5'-most nucleoside to which the gapmer is targeted in the human gene sequence. "Human Target stop site" indicates the 3'-most nucleoside to which the gapmer is targeted in the human gene sequence. Each gapmer listed in Table 11 is targeted to human STAT3 mRNA, designated herein as SEQ ID NO: 1 (GENBANK Accession No. NM_139276.2).

TABLE 11

Inhibition of human STAT3 mRNA levels by chimeric antisense oligonuclotides targeted to SEQ ID NO: 1

| Human Start Site | Human Stop Site | ISIS No | Sequence | Chemistry | % inhibition | SEQ ID NO |
|---|---|---|---|---|---|---|
| 1 | 16 | 528170 | CGCAGCTCCGGAAACC | e-e-e-d$_{(10)}$-k-k-k | 12 | 471 |
| 2 | 17 | 528171 | CCGCAGCTCCGGAAAC | e-e-e-d$_{(10)}$-k-k-k | 11 | 472 |
| 4 | 19 | 528172 | CGCCGCAGCTCCGGAA | e-e-e-d$_{(10)}$-k-k-k | 10 | 473 |
| 5 | 20 | 528173 | CCGCCGCAGCTCCGGA | e-e-e-d$_{(10)}$-k-k-k | 22 | 474 |
| 32 | 47 | 528174 | ACCCCCGGCTCCCCCT | e-e-e-d$_{(10)}$-k-k-k | 18 | 475 |
| 34 | 49 | 528175 | GAACCCCCGGCTCCCC | e-e-e-d$_{(10)}$-k-k-k | 17 | 476 |
| 35 | 50 | 528176 | GGAACCCCCGGCTCCC | e-e-e-d$_{(10)}$-k-k-k | 23 | 477 |
| 36 | 51 | 528177 | CGGAACCCCCGGCTCC | e-e-e-d$_{(10)}$-k-k-k | 15 | 478 |
| 38 | 53 | 528178 | GTCGGAACCCCCGGCT | e-e-e-d$_{(10)}$-k-k-k | 21 | 479 |
| 39 | 54 | 528179 | CGTCGGAACCCCCGGC | e-e-e-d$_{(10)}$-k-k-k | 19 | 480 |
| 57 | 72 | 528180 | TTGTTCCCTCGGCTGC | e-e-e-d$_{(10)}$-k-k-k | 40 | 481 |
| 58 | 73 | 528181 | CTTGTTCCCTCGGCTG | e-e-e-d$_{(10)}$-k-k-k | 28 | 482 |
| 60 | 75 | 528182 | GGCTTGTTCCCTCGGC | e-e-e-d$_{(10)}$-k-k-k | 25 | 483 |
| 61 | 76 | 528183 | GGGCTTGTTCCCTCGG | e-e-e-d$_{(10)}$-k-k-k | 34 | 484 |
| 75 | 90 | 528184 | CCAGGATCCGGTTGGG | e-e-e-d$_{(10)}$-k-k-k | 34 | 485 |
| 76 | 91 | 528185 | TCCAGGATCCGGTTGG | e-e-e-d$_{(10)}$-k-k-k | 15 | 9 |
| 77 | 92 | 528186 | GTCCAGGATCCGGTTG | e-e-e-d$_{(10)}$-k-k-k | 28 | 486 |
| 78 | 93 | 528187 | TGTCCAGGATCCGGTT | e-e-e-d$_{(10)}$-k-k-k | 27 | 487 |
| 79 | 94 | 528188 | CTGTCCAGGATCCGGT | e-e-e-d$_{(10)}$-k-k-k | 33 | 488 |
| 81 | 96 | 528189 | GCCTGTCCAGGATCCG | e-e-e-d$_{(10)}$-k-k-k | 63 | 489 |
| 83 | 98 | 528190 | GTGCCTGTCCAGGATC | e-e-e-d$_{(10)}$-k-k-k | 36 | 490 |
| 189 | 204 | 528191 | AGAGGCCGAGAGGCCG | e-e-e-d$_{(10)}$-k-k-k | 2 | 491 |
| 210 | 225 | 528192 | GGTCCCAACTGTTTCT | e-e-e-d$_{(10)}$-k-k-k | 11 | 492 |
| 232 | 247 | 528193 | GGGCCATCCTGCTAAA | e-e-e-d$_{(10)}$-k-k-k | 14 | 493 |

TABLE 11-continued

Inhibition of human STAT3 mRNA levels by chimeric antisense oligonuclotides targeted to SEQ ID NO: 1

| Human Start Site | Human Stop Site | ISIS No | Sequence | Chemistry | % inhibition | SEQ ID NO |
|---|---|---|---|---|---|---|
| 233 | 248 | 528194 | TGGGCCATCCTGCTAA | e-e-e-d$_{(10)}$-k-k-k | 16 | 494 |
| 234 | 249 | 528195 | TTGGGCCATCCTGCTA | e-e-e-d$_{(10)}$-k-k-k | 9 | 495 |
| 236 | 251 | 528196 | CATTGGGCCATCCTGC | e-e-e-d$_{(10)}$-k-k-k | 39 | 496 |
| 237 | 252 | 528197 | CCATTGGGCCATCCTG | e-e-e-d$_{(10)}$-k-k-k | 38 | 497 |
| 239 | 254 | 528198 | TTCCATTGGGCCATCC | e-e-e-d$_{(10)}$-k-k-k | 19 | 498 |
| 240 | 255 | 528199 | ATTCCATTGGGCCATC | e-e-e-d$_{(10)}$-k-k-k | 27 | 15 |
| 244 | 259 | 528200 | GCTGATTCCATTGGGC | e-e-e-d$_{(10)}$-k-k-k | 18 | 500 |
| 245 | 260 | 528201 | AGCTGATTCCATTGGG | e-e-e-d$_{(10)}$-k-k-k | 20 | 501 |
| 246 | 261 | 528202 | TAGCTGATTCCATTGG | e-e-e-d$_{(10)}$-k-k-k | 41 | 502 |
| 247 | 262 | 528203 | GTAGCTGATTCCATTG | e-e-e-d$_{(10)}$-k-k-k | 37 | 503 |
| 250 | 265 | 528204 | GCTGTAGCTGATTCCA | e-e-e-d$_{(10)}$-k-k-k | 83 | 504 |
| 251 | 266 | 528205 | TGCTGTAGCTGATTCC | e-e-e-d$_{(10)}$-k-k-k | 72 | 505 |
| 252 | 267 | 528206 | CTGCTGTAGCTGATTC | e-e-e-d$_{(10)}$-k-k-k | 44 | 506 |
| 253 | 268 | 528207 | GCTGCTGTAGCTGATT | e-e-e-d$_{(10)}$-k-k-k | 49 | 507 |
| 263 | 278 | 528208 | CGTGTGTCAAGCTGCT | e-e-e-d$_{(10)}$-k-k-k | 73 | 508 |
| 264 | 279 | 528209 | CCGTGTGTCAAGCTGC | e-e-e-d$_{(10)}$-k-k-k | 81 | 17 |
| 265 | 280 | 528210 | ACCGTGTGTCAAGCTG | e-e-e-d$_{(10)}$-k-k-k | 78 | 509 |
| 266 | 281 | 528211 | TACCGTGTGTCAAGCT | e-e-e-d$_{(10)}$-k-k-k | 72 | 510 |
| 267 | 282 | 528212 | GTACCGTGTGTCAAGC | e-e-e-d$_{(10)}$-k-k-k | 81 | 511 |
| 268 | 283 | 528213 | GGTACCGTGTGTCAAG | e-e-e-d$_{(10)}$-k-k-k | 46 | 512 |
| 270 | 285 | 528214 | CAGGTACCGTGTGTCA | e-e-e-d$_{(10)}$-k-k-k | 80 | 513 |
| 271 | 286 | 528215 | CCAGGTACCGTGTGTC | e-e-e-d$_{(10)}$-k-k-k | 69 | 514 |
| 272 | 287 | 528216 | TCCAGGTACCGTGTGT | e-e-e-d$_{(10)}$-k-k-k | 41 | 515 |
| 273 | 288 | 528217 | CTCCAGGTACCGTGTG | e-e-e-d$_{(10)}$-k-k-k | 44 | 516 |
| 274 | 289 | 528218 | GCTCCAGGTACCGTGT | e-e-e-d$_{(10)}$-k-k-k | 32 | 517 |
| 275 | 290 | 528219 | TGCTCCAGGTACCGTG | e-e-e-d$_{(10)}$-k-k-k | 50 | 518 |
| 291 | 306 | 528220 | GTAGAGCTGATGGAGC | e-e-e-d$_{(10)}$-k-k-k | 12 | 519 |
| 292 | 307 | 528221 | TGTAGAGCTGATGGAG | e-e-e-d$_{(10)}$-k-k-k | 0 | 520 |
| 295 | 310 | 528222 | CACTGTAGAGCTGATG | e-e-e-d$_{(10)}$-k-k-k | 0 | 521 |
| 297 | 312 | 528223 | GTCACTGTAGAGCTGA | e-e-e-d$_{(10)}$-k-k-k | 44 | 522 |
| 302 | 317 | 528224 | AAGCTGTCACTGTAGA | e-e-e-d$_{(10)}$-k-k-k | 20 | 523 |
| 303 | 318 | 528225 | GAAGCTGTCACTGTAG | e-e-e-d$_{(10)}$-k-k-k | 24 | 524 |
| 307 | 322 | 528226 | TTGGGAAGCTGTCACT | e-e-e-d$_{(10)}$-k-k-k | 35 | 525 |
| 308 | 323 | 528227 | ATTGGGAAGCTGTCAC | e-e-e-d$_{(10)}$-k-k-k | 29 | 526 |
| 310 | 325 | 528228 | CCATTGGGAAGCTGTC | e-e-e-d$_{(10)}$-k-k-k | 33 | 527 |
| 322 | 337 | 519639 | ACTGCCGCAGCTCCAT | e-e-e-d$_{(10)}$-k-k-k | 37 | 19 |
| 329 | 344 | 528229 | GCCAGAAACTGCCGCA | e-e-e-d$_{(10)}$-k-k-k | 20 | 528 |

TABLE 11-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 330 | 345 | 528230 | GGCCAGAAACTGCCGC | e-e-e-d$_{(10)}$-k-k-k | 1 | 529 |
| 331 | 346 | 528231 | GGGCCAGAAACTGCCG | e-e-e-d$_{(10)}$-k-k-k | 1 | 530 |
| 345 | 360 | 528232 | ACTCTCAATCCAAGGG | e-e-e-d$_{(10)}$-k-k-k | 14 | 531 |
| 346 | 361 | 528233 | GACTCTCAATCCAAGG | e-e-e-d$_{(10)}$-k-k-k | 10 | 21 |
| 347 | 362 | 528234 | TGACTCTCAATCCAAG | e-e-e-d$_{(10)}$-k-k-k | 6 | 532 |
| 351 | 366 | 528235 | ATCTTGACTCTCAATC | e-e-e-d$_{(10)}$-k-k-k | 38 | 533 |
| 353 | 368 | 528236 | CAATCTTGACTCTCAA | e-e-e-d$_{(10)}$-k-k-k | 29 | 534 |
| 354 | 369 | 528237 | CCAATCTTGACTCTCA | e-e-e-d$_{(10)}$-k-k-k | 60 | 535 |
| 355 | 370 | 528238 | CCCAATCTTGACTCTC | e-e-e-d$_{(10)}$-k-k-k | 37 | 536 |
| 356 | 371 | 528239 | GCCCAATCTTGACTCT | e-e-e-d$_{(10)}$-k-k-k | 48 | 537 |
| 357 | 372 | 528240 | TGCCCAATCTTGACTC | e-e-e-d$_{(10)}$-k-k-k | 40 | 538 |
| 358 | 373 | 528241 | ATGCCCAATCTTGACT | e-e-e-d$_{(10)}$-k-k-k | 21 | 539 |
| 359 | 374 | 528242 | TATGCCCAATCTTGAC | e-e-e-d$_{(10)}$-k-k-k | 27 | 540 |
| 362 | 377 | 528243 | GCATATGCCCAATCTT | e-e-e-d$_{(10)}$-k-k-k | 16 | 541 |
| 363 | 378 | 528244 | CGCATATGCCCAATCT | e-e-e-d$_{(10)}$-k-k-k | 50 | 542 |
| 367 | 382 | 528245 | TGGCCGCATATGCCCA | e-e-e-d$_{(10)}$-k-k-k | 67 | 543 |
| 368 | 383 | 528246 | CTGGCCGCATATGCCC | e-e-e-d$_{(10)}$-k-k-k | 47 | 544 |
| 369 | 384 | 528247 | GCTGGCCGCATATGCC | e-e-e-d$_{(10)}$-k-k-k | 54 | 545 |
| 370 | 385 | 528248 | TGCTGGCCGCATATGC | e-e-e-d$_{(10)}$-k-k-k | 35 | 546 |
| 371 | 386 | 528249 | TTGCTGGCCGCATATG | e-e-e-d$_{(10)}$-k-k-k | 22 | 547 |
| 372 | 387 | 528250 | TTTGCTGGCCGCATAT | e-e-e-d$_{(10)}$-k-k-k | 19 | 548 |
| 373 | 388 | 528251 | CTTTGCTGGCCGCATA | e-e-e-d$_{(10)}$-k-k-k | 27 | 549 |
| 374 | 389 | 528252 | TCTTTGCTGGCCGCAT | e-e-e-d$_{(10)}$-k-k-k | 34 | 550 |
| 375 | 390 | 528253 | TTCTTTGCTGGCCGCA | e-e-e-d$_{(10)}$-k-k-k | 59 | 23 |
| 376 | 391 | 528254 | ATTCTTTGCTGGCCGC | e-e-e-d$_{(10)}$-k-k-k | 63 | 551 |
| 378 | 393 | 528255 | TGATTCTTTGCTGGCC | e-e-e-d$_{(10)}$-k-k-k | 30 | 552 |
| 379 | 394 | 528256 | GTGATTCTTTGCTGGC | e-e-e-d$_{(10)}$-k-k-k | 47 | 553 |
| 383 | 398 | 528257 | GCATGTGATTCTTTGC | e-e-e-d$_{(10)}$-k-k-k | 43 | 554 |
| 384 | 399 | 528258 | GGCATGTGATTCTTTG | e-e-e-d$_{(10)}$-k-k-k | 47 | 555 |
| 388 | 403 | 528259 | AAGTGGCATGTGATTC | e-e-e-d$_{(10)}$-k-k-k | 43 | 556 |
| 391 | 406 | 528260 | CCAAAGTGGCATGTGA | e-e-e-d$_{(10)}$-k-k-k | 46 | 557 |
| 393 | 408 | 528261 | CACCAAAGTGGCATGT | e-e-e-d$_{(10)}$-k-k-k | 32 | 558 |
| 395 | 410 | 528262 | AACACCAAAGTGGCAT | e-e-e-d$_{(10)}$-k-k-k | 41 | 559 |
| 397 | 412 | 528263 | GAAACACCAAAGTGGC | e-e-e-d$_{(10)}$-k-k-k | 69 | 560 |
| 427 | 442 | 528264 | ACTGCTGGTCAATCTC | e-e-e-d$_{(10)}$-k-k-k | 27 | 561 |
| 428 | 443 | 528265 | TACTGCTGGTCAATCT | e-e-e-d$_{(10)}$-k-k-k | 32 | 562 |

TABLE 11-continued

Inhibition of human STAT3 mRNA levels by chimeric antisense oligonuclotides targeted to SEQ ID NO: 1

| Human Start Site | Human Stop Site | ISIS No | Sequence | Chemistry | % inhibition | SEQ ID NO |
|---|---|---|---|---|---|---|
| 430 | 445 | 528266 | TATACTGCTGGTCAAT | e-e-e-d$_{(10)}$-k-k-k | 27 | 563 |
| 431 | 446 | 528267 | CTATACTGCTGGTCAA | e-e-e-d$_{(10)}$-k-k-k | 38 | 564 |
| 432 | 447 | 528268 | GCTATACTGCTGGTCA | e-e-e-d$_{(10)}$-k-k-k | 58 | 565 |
| 433 | 448 | 528269 | GGCTATACTGCTGGTC | e-e-e-d$_{(10)}$-k-k-k | 69 | 566 |
| 434 | 449 | 528270 | CGGCTATACTGCTGGT | e-e-e-d$_{(10)}$-k-k-k | 73 | 567 |
| 435 | 450 | 528271 | GCGGCTATACTGCTGG | e-e-e-d$_{(10)}$-k-k-k | 71 | 568 |
| 436 | 451 | 528272 | AGCGGCTATACTGCTG | e-e-e-d$_{(10)}$-k-k-k | 54 | 569 |
| 437 | 452 | 528273 | AAGCGGCTATACTGCT | e-e-e-d$_{(10)}$-k-k-k | 36 | 570 |
| 439 | 454 | 528274 | GGAAGCGGCTATACTG | e-e-e-d$_{(10)}$-k-k-k | 27 | 571 |
| 440 | 455 | 528275 | AGGAAGCGGCTATACT | e-e-e-d$_{(10)}$-k-k-k | 21 | 572 |
| 441 | 456 | 528276 | CAGGAAGCGGCTATAC | e-e-e-d$_{(10)}$-k-k-k | 12 | 573 |
| 442 | 457 | 528277 | GCAGGAAGCGGCTATA | e-e-e-d$_{(10)}$-k-k-k | 14 | 574 |
| 443 | 458 | 528278 | TGCAGGAAGCGGCTAT | e-e-e-d$_{(10)}$-k-k-k | 21 | 575 |
| 444 | 459 | 528279 | TTGCAGGAAGCGGCTA | e-e-e-d$_{(10)}$-k-k-k | 31 | 576 |
| 445 | 460 | 528280 | CTTGCAGGAAGCGGCT | e-e-e-d$_{(10)}$-k-k-k | 44 | 577 |
| 463 | 478 | 528281 | GATAGAGAACATTCGA | e-e-e-d$_{(10)}$-k-k-k | 25 | 578 |
| 464 | 479 | 528282 | TGATAGAGAACATTCG | e-e-e-d$_{(10)}$-k-k-k | 39 | 579 |
| 469 | 484 | 528283 | TGTGCTGATAGAGAAC | e-e-e-d$_{(10)}$-k-k-k | 41 | 580 |
| 471 | 486 | 528284 | ATTGTGCTGATAGAGA | e-e-e-d$_{(10)}$-k-k-k | 38 | 581 |
| 472 | 487 | 528285 | GATTGTGCTGATAGAG | e-e-e-d$_{(10)}$-k-k-k | 50 | 582 |
| 473 | 488 | 528286 | AGATTGTGCTGATAGA | e-e-e-d$_{(10)}$-k-k-k | 49 | 583 |
| 475 | 490 | 528287 | GTAGATTGTGCTGATA | e-e-e-d$_{(10)}$-k-k-k | 14 | 584 |
| 476 | 491 | 528288 | CGTAGATTGTGCTGAT | e-e-e-d$_{(10)}$-k-k-k | 8 | 585 |
| 490 | 505 | 528289 | ACTGCTTGATTCTTCG | e-e-e-d$_{(10)}$-k-k-k | 9 | 33 |
| 511 | 526 | 528290 | CAAGATACCTGCTCTG | e-e-e-d$_{(10)}$-k-k-k | 48 | 35 |
| 512 | 527 | 528291 | TCAAGATACCTGCTCT | e-e-e-d$_{(10)}$-k-k-k | 34 | 586 |
| 513 | 528 | 528292 | CTCAAGATACCTGCTC | e-e-e-d$_{(10)}$-k-k-k | 19 | 587 |
| 514 | 529 | 528293 | TCTCAAGATACCTGCT | e-e-e-d$_{(10)}$-k-k-k | 31 | 588 |
| 517 | 532 | 528294 | GCTTCTCAAGATACCT | e-e-e-d$_{(10)}$-k-k-k | 42 | 589 |
| 519 | 534 | 528295 | TGGCTTCTCAAGATAC | e-e-e-d$_{(10)}$-k-k-k | 37 | 590 |
| 522 | 537 | 528296 | CATTGGCTTCTCAAGA | e-e-e-d$_{(10)}$-k-k-k | 11 | 591 |
| 523 | 538 | 528297 | CCATTGGCTTCTCAAG | e-e-e-d$_{(10)}$-k-k-k | 23 | 592 |
| 530 | 545 | 528298 | GCAATCTCCATTGGCT | e-e-e-d$_{(10)}$-k-k-k | 46 | 593 |
| 531 | 546 | 528299 | GGCAATCTCCATTGGC | e-e-e-d$_{(10)}$-k-k-k | 37 | 594 |
| 532 | 547 | 528300 | GGGCAATCTCCATTGG | e-e-e-d$_{(10)}$-k-k-k | 24 | 595 |
| 533 | 548 | 528301 | CGGGCAATCTCCATTG | e-e-e-d$_{(10)}$-k-k-k | 15 | 596 |
| 534 | 549 | 528302 | CCGGGCAATCTCCATT | e-e-e-d$_{(10)}$-k-k-k | 30 | 597 |

TABLE 11-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 535 | 550 | 528303 | TCCGGGCAATCTCCAT | e-e-e-d$_{(10)}$-k-k-k | 29 | 598 |
| 536 | 551 | 528304 | ATCCGGGCAATCTCCA | e-e-e-d$_{(10)}$-k-k-k | 32 | 599 |
| 537 | 552 | 528305 | AATCCGGGCAATCTCC | e-e-e-d$_{(10)}$-k-k-k | 32 | 600 |
| 538 | 553 | 528306 | CAATCCGGGCAATCTC | e-e-e-d$_{(10)}$-k-k-k | 24 | 601 |
| 539 | 554 | 528307 | ACAATCCGGGCAATCT | e-e-e-d$_{(10)}$-k-k-k | 21 | 602 |
| 540 | 555 | 528308 | CACAATCCGGGCAATC | e-e-e-d$_{(10)}$-k-k-k | 14 | 603 |
| 541 | 556 | 528309 | CCACAATCCGGGCAAT | e-e-e-d$_{(10)}$-k-k-k | 13 | 604 |
| 543 | 558 | 528310 | GGCCACAATCCGGGCA | e-e-e-d$_{(10)}$-k-k-k | 27 | 605 |
| 546 | 561 | 528311 | CCGGGCCACAATCCGG | e-e-e-d$_{(10)}$-k-k-k | 27 | 606 |
| 547 | 562 | 528312 | ACCGGGCCACAATCCG | e-e-e-d$_{(10)}$-k-k-k | 58 | 607 |
| 548 | 563 | 528313 | CACCGGGCCACAATCC | e-e-e-d$_{(10)}$-k-k-k | 25 | 608 |
| 549 | 564 | 528314 | GCACCGGGCCACAATC | e-e-e-d$_{(10)}$-k-k-k | 18 | 609 |
| 550 | 565 | 528315 | GGCACCGGGCCACAAT | e-e-e-d$_{(10)}$-k-k-k | 33 | 610 |
| 551 | 566 | 528316 | AGGCACCGGGCCACAA | e-e-e-d$_{(10)}$-k-k-k | 42 | 611 |
| 558 | 573 | 528317 | TTCCCACAGGCACCGG | e-e-e-d$_{(10)}$-k-k-k | 47 | 612 |
| 586 | 601 | 528318 | TGGCTGCAGTCTGTAG | e-e-e-d$_{(10)}$-k-k-k | 12 | 613 |
| 592 | 607 | 528319 | CCGCAGTGGCTGCAGT | e-e-e-d$_{(10)}$-k-k-k | 10 | 614 |
| 599 | 614 | 528320 | TGCTGGGCCGCAGTGG | e-e-e-d$_{(10)}$-k-k-k | 14 | 615 |
| 601 | 616 | 528321 | CTTGCTGGGCCGCAGT | e-e-e-d$_{(10)}$-k-k-k | 0 | 616 |
| 603 | 618 | 528322 | CCCTTGCTGGGCCGCA | e-e-e-d$_{(10)}$-k-k-k | 6 | 617 |
| 604 | 619 | 528323 | CCCCTTGCTGGGCCGC | e-e-e-d$_{(10)}$-k-k-k | 21 | 618 |
| 605 | 620 | 528324 | CCCCCTTGCTGGGCCG | e-e-e-d$_{(10)}$-k-k-k | 8 | 619 |
| 608 | 623 | 528325 | TGGCCCCCTTGCTGGG | e-e-e-d$_{(10)}$-k-k-k | 0 | 620 |
| 615 | 630 | 528326 | GTTGGCCTGGCCCCCT | e-e-e-d$_{(10)}$-k-k-k | 31 | 621 |
| 616 | 631 | 528327 | GGTTGGCCTGGCCCCC | e-e-e-d$_{(10)}$-k-k-k | 47 | 622 |
| 617 | 632 | 528328 | TGGTTGGCCTGGCCCC | e-e-e-d$_{(10)}$-k-k-k | 36 | 623 |
| 646 | 661 | 528329 | GCTTCTCCGTCACCAC | e-e-e-d$_{(10)}$-k-k-k | 28 | 624 |
| 647 | 662 | 528330 | TGCTTCTCCGTCACCA | e-e-e-d$_{(10)}$-k-k-k | 22 | 625 |
| 649 | 664 | 528331 | GCTGCTTCTCCGTCAC | e-e-e-d$_{(10)}$-k-k-k | 35 | 626 |
| 667 | 682 | 528332 | GGTGCTGCTCCAGCAT | e-e-e-d$_{(10)}$-k-k-k | 21 | 627 |
| 678 | 693 | 528333 | GACATCCTGAAGGTGC | e-e-e-d$_{(10)}$-k-k-k | 0 | 628 |
| 682 | 697 | 528334 | TCCGGACATCCTGAAG | e-e-e-d$_{(10)}$-k-k-k | 1 | 629 |
| 683 | 698 | 528335 | TTCCGGACATCCTGAA | e-e-e-d$_{(10)}$-k-k-k | 0 | 630 |
| 684 | 699 | 528336 | CTTCCGGACATCCTGA | e-e-e-d$_{(10)}$-k-k-k | 0 | 631 |
| 685 | 700 | 528337 | TCTTCCGGACATCCTG | e-e-e-d$_{(10)}$-k-k-k | 0 | 632 |
| 686 | 701 | 528338 | CTCTTCCGGACATCCT | e-e-e-d$_{(10)}$-k-k-k | 19 | 633 |

TABLE 11-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 687 | 702 | 528339 | TCTCTTCCGGACATCC | e-e-e-d$_{(10)}$-k-k-k | 21 | 634 |
| 688 | 703 | 528340 | CTCTCTTCCGGACATC | e-e-e-d$_{(10)}$-k-k-k | 17 | 635 |
| 689 | 704 | 528341 | ACTCTCTTCCGGACAT | e-e-e-d$_{(10)}$-k-k-k | 37 | 636 |
| 727 | 742 | 528342 | GATTCTCTACCACTTT | e-e-e-d$_{(10)}$-k-k-k | 33 | 637 |
| 730 | 745 | 528343 | GGAGATTCTCTACCAC | e-e-e-d$_{(10)}$-k-k-k | 40 | 53 |
| 731 | 746 | 528344 | TGGAGATTCTCTACCA | e-e-e-d$_{(10)}$-k-k-k | 32 | 638 |
| 732 | 747 | 528345 | CTGGAGATTCTCTACC | e-e-e-d$_{(10)}$-k-k-k | 18 | 639 |
| 733 | 748 | 528346 | CCTGGAGATTCTCTAC | e-e-e-d$_{(10)}$-k-k-k | 12 | 640 |
| 738 | 753 | 528347 | GTCATCCTGGAGATTC | e-e-e-d$_{(10)}$-k-k-k | 54 | 641 |
| 764 | 779 | 528348 | TTGAGGGTTTTATAGT | e-e-e-d$_{(10)}$-k-k-k | 0 | 642 |
| 775 | 790 | 528349 | CTCCTTGACTCTTGAG | e-e-e-d$_{(10)}$-k-k-k | 21 | 643 |
| 781 | 796 | 528350 | GCATGTCTCCTTGACT | e-e-e-d$_{(10)}$-k-k-k | 29 | 644 |
| 782 | 797 | 528351 | TGCATGTCTCCTTGAC | e-e-e-d$_{(10)}$-k-k-k | 30 | 645 |
| 783 | 798 | 528352 | TTGCATGTCTCCTTGA | e-e-e-d$_{(10)}$-k-k-k | 17 | 646 |
| 787 | 802 | 528353 | GATCTTGCATGTCTCC | e-e-e-d$_{(10)}$-k-k-k | 61 | 647 |
| 788 | 803 | 518346 | AGATCTTGCATGTCTC | e-e-e-d$_{(10)}$-k-k-k | 36 | 57 |
| 790 | 805 | 528354 | TCAGATCTTGCATGTC | e-e-e-d$_{(10)}$-k-k-k | 43 | 648 |
| 792 | 807 | 528355 | ATTCAGATCTTGCATG | e-e-e-d$_{(10)}$-k-k-k | 9 | 649 |
| 794 | 809 | 528356 | CCATTCAGATCTTGCA | e-e-e-d$_{(10)}$-k-k-k | 37 | 650 |
| 795 | 810 | 528357 | TCCATTCAGATCTTGC | e-e-e-d$_{(10)}$-k-k-k | 55 | 651 |
| 796 | 811 | 528358 | TTCCATTCAGATCTTG | e-e-e-d$_{(10)}$-k-k-k | 17 | 652 |
| 803 | 818 | 528359 | TGGTTGTTTCCATTCA | e-e-e-d$_{(10)}$-k-k-k | 33 | 653 |
| 804 | 819 | 528360 | CTGGTTGTTTCCATTC | e-e-e-d$_{(10)}$-k-k-k | 18 | 654 |
| 806 | 821 | 528361 | GACTGGTTGTTTCCAT | e-e-e-d$_{(10)}$-k-k-k | 23 | 655 |
| 807 | 822 | 528362 | TGACTGGTTGTTTCCA | e-e-e-d$_{(10)}$-k-k-k | 33 | 656 |
| 813 | 828 | 528363 | GGTCACTGACTGGTTG | e-e-e-d$_{(10)}$-k-k-k | 43 | 657 |
| 814 | 829 | 528364 | TGGTCACTGACTGGTT | e-e-e-d$_{(10)}$-k-k-k | 62 | 658 |
| 848 | 863 | 528365 | GTGAGCATCTGTTCCA | e-e-e-d$_{(10)}$-k-k-k | 41 | 659 |
| 852 | 867 | 528366 | CGCAGTGAGCATCTGT | e-e-e-d$_{(10)}$-k-k-k | 0 | 660 |
| 853 | 868 | 528367 | GCGCAGTGAGCATCTG | e-e-e-d$_{(10)}$-k-k-k | 0 | 661 |
| 854 | 869 | 528368 | AGCGCAGTGAGCATCT | e-e-e-d$_{(10)}$-k-k-k | 7 | 662 |
| 855 | 870 | 528369 | CAGCGCAGTGAGCATC | e-e-e-d$_{(10)}$-k-k-k | 6 | 663 |
| 857 | 872 | 528370 | TCCAGCGCAGTGAGCA | e-e-e-d$_{(10)}$-k-k-k | 12 | 664 |
| 858 | 873 | 528371 | GTCCAGCGCAGTGAGC | e-e-e-d$_{(10)}$-k-k-k | 11 | 665 |
| 859 | 874 | 528372 | GGTCCAGCGCAGTGAG | e-e-e-d$_{(10)}$-k-k-k | 8 | 666 |
| 860 | 875 | 528373 | TGGTCCAGCGCAGTGA | e-e-e-d$_{(10)}$-k-k-k | 12 | 667 |
| 862 | 877 | 528374 | TCTGGTCCAGCGCAGT | e-e-e-d$_{(10)}$-k-k-k | 9 | 668 |

TABLE 11-continued

Inhibition of human STAT3 mRNA levels by chimeric antisense oligonuclotides targeted to SEQ ID NO: 1

| Human Start Site | Human Stop Site | ISIS No | Sequence | Chemistry | % inhibition | SEQ ID NO |
|---|---|---|---|---|---|---|
| 863 | 878 | 528375 | ATCTGGTCCAGCGCAG | e-e-e-d$_{(10)}$-k-k-k | 8 | 669 |
| 864 | 879 | 528376 | CATCTGGTCCAGCGCA | e-e-e-d$_{(10)}$-k-k-k | 0 | 670 |
| 865 | 880 | 528377 | GCATCTGGTCCAGCGC | e-e-e-d$_{(10)}$-k-k-k | 28 | 671 |
| 867 | 882 | 528378 | CCGCATCTGGTCCAGC | e-e-e-d$_{(10)}$-k-k-k | 72 | 672 |
| 868 | 883 | 528379 | TCCGCATCTGGTCCAG | e-e-e-d$_{(10)}$-k-k-k | 43 | 61 |
| 869 | 884 | 528380 | CTCCGCATCTGGTCCA | e-e-e-d$_{(10)}$-k-k-k | 34 | 673 |
| 870 | 885 | 528381 | TCTCCGCATCTGGTCC | e-e-e-d$_{(10)}$-k-k-k | 42 | 674 |
| 871 | 886 | 528382 | TTCTCCGCATCTGGTC | e-e-e-d$_{(10)}$-k-k-k | 37 | 675 |
| 872 | 887 | 528383 | CTTCTCCGCATCTGGT | e-e-e-d$_{(10)}$-k-k-k | 23 | 676 |
| 873 | 888 | 528384 | GCTTCTCCGCATCTGG | e-e-e-d$_{(10)}$-k-k-k | 36 | 677 |
| 875 | 890 | 528385 | ATGCTTCTCCGCATCT | e-e-e-d$_{(10)}$-k-k-k | 45 | 678 |
| 876 | 891 | 528386 | GATGCTTCTCCGCATC | e-e-e-d$_{(10)}$-k-k-k | 14 | 679 |
| 877 | 892 | 528387 | CGATGCTTCTCCGCAT | e-e-e-d$_{(10)}$-k-k-k | 25 | 680 |
| 878 | 893 | 528388 | ACGATGCTTCTCCGCA | e-e-e-d$_{(10)}$-k-k-k | 39 | 681 |
| 879 | 894 | 528389 | CACGATGCTTCTCCGC | e-e-e-d$_{(10)}$-k-k-k | 46 | 682 |
| 880 | 895 | 528390 | TCACGATGCTTCTCCG | e-e-e-d$_{(10)}$-k-k-k | 17 | 683 |
| 881 | 896 | 528391 | CTCACGATGCTTCTCC | e-e-e-d$_{(10)}$-k-k-k | 20 | 684 |
| 882 | 897 | 528392 | ACTCACGATGCTTCTC | e-e-e-d$_{(10)}$-k-k-k | 16 | 685 |
| 883 | 898 | 528393 | CACTCACGATGCTTCT | e-e-e-d$_{(10)}$-k-k-k | 39 | 686 |
| 885 | 900 | 528394 | CTCACTCACGATGCTT | e-e-e-d$_{(10)}$-k-k-k | 45 | 687 |
| 886 | 901 | 528395 | GCTCACTCACGATGCT | e-e-e-d$_{(10)}$-k-k-k | 37 | 688 |
| 888 | 903 | 528396 | CAGCTCACTCACGATG | e-e-e-d$_{(10)}$-k-k-k | 24 | 689 |
| 889 | 904 | 528397 | CCAGCTCACTCACGAT | e-e-e-d$_{(10)}$-k-k-k | 25 | 690 |
| 890 | 905 | 528398 | GCCAGCTCACTCACGA | e-e-e-d$_{(10)}$-k-k-k | 18 | 691 |
| 891 | 906 | 528399 | CGCCAGCTCACTCACG | e-e-e-d$_{(10)}$-k-k-k | 4 | 692 |
| 1068 | 1083 | 528477 | AATTTGTTGACGGGTC | e-e-e-d$_{(10)}$-k-k-k | 37 | 693 |
| 1069 | 1084 | 528478 | TAATTTGTTGACGGGT | e-e-e-d$_{(10)}$-k-k-k | 35 | 694 |
| 1070 | 1085 | 528479 | TTAATTTGTTGACGGG | e-e-e-d$_{(10)}$-k-k-k | 40 | 695 |
| 1072 | 1087 | 528480 | TCTTAATTTGTTGACG | e-e-e-d$_{(10)}$-k-k-k | 6 | 696 |
| 1087 | 1102 | 528481 | GCAACTCCTCCAGTTT | e-e-e-d$_{(10)}$-k-k-k | 42 | 697 |
| 1088 | 1103 | 528482 | TGCAACTCCTCCAGTT | e-e-e-d$_{(10)}$-k-k-k | 28 | 698 |
| 1094 | 1109 | 528483 | TTTTGCTGCAACTCCT | e-e-e-d$_{(10)}$-k-k-k | 49 | 699 |
| 1095 | 1110 | 528484 | TTTTTGCTGCAACTCC | e-e-e-d$_{(10)}$-k-k-k | 58 | 700 |
| 1114 | 1129 | 528485 | GGTCCCCTTTGTAGGA | e-e-e-d$_{(10)}$-k-k-k | 35 | 701 |
| 1115 | 1130 | 528486 | GGGTCCCCTTTGTAGG | e-e-e-d$_{(10)}$-k-k-k | 31 | 702 |
| 1129 | 1144 | 528487 | GGTGCTGTACAATGGG | e-e-e-d$_{(10)}$-k-k-k | 61 | 703 |

TABLE 11-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 1130 | 1145 | 528488 | CGGTGCTGTACAATGG | e-e-e-d$_{(10)}$-k-k-k | 61 | 704 |
| 1131 | 1146 | 528489 | CCGGTGCTGTACAATG | e-e-e-d$_{(10)}$-k-k-k | 37 | 705 |
| 1132 | 1147 | 528490 | GCCGGTGCTGTACAAT | e-e-e-d$_{(10)}$-k-k-k | 33 | 706 |
| 1133 | 1148 | 528491 | GGCCGGTGCTGTACAA | e-e-e-d$_{(10)}$-k-k-k | 39 | 707 |
| 1134 | 1149 | 528492 | CGGCCGGTGCTGTACA | e-e-e-d$_{(10)}$-k-k-k | 38 | 708 |
| 1136 | 1151 | 528493 | ATCGGCCGGTGCTGTA | e-e-e-d$_{(10)}$-k-k-k | 29 | 709 |
| 1137 | 1152 | 528494 | CATCGGCCGGTGCTGT | e-e-e-d$_{(10)}$-k-k-k | 43 | 710 |
| 1138 | 1153 | 528495 | GCATCGGCCGGTGCTG | e-e-e-d$_{(10)}$-k-k-k | 41 | 711 |
| 1139 | 1154 | 528496 | AGCATCGGCCGGTGCT | e-e-e-d$_{(10)}$-k-k-k | 18 | 712 |
| 1140 | 1155 | 528497 | CAGCATCGGCCGGTGC | e-e-e-d$_{(10)}$-k-k-k | 15 | 713 |
| 1141 | 1156 | 528498 | CCAGCATCGGCCGGTG | e-e-e-d$_{(10)}$-k-k-k | 39 | 714 |
| 1142 | 1157 | 528499 | TCCAGCATCGGCCGGT | e-e-e-d$_{(10)}$-k-k-k | 50 | 715 |
| 1144 | 1159 | 528500 | CCTCCAGCATCGGCCG | e-e-e-d$_{(10)}$-k-k-k | 58 | 716 |
| 1146 | 1161 | 528501 | CTCCTCCAGCATCGGC | e-e-e-d$_{(10)}$-k-k-k | 67 | 717 |
| 1147 | 1162 | 528502 | TCTCCTCCAGCATCGG | e-e-e-d$_{(10)}$-k-k-k | 76 | 718 |
| 1153 | 1168 | 528503 | CGATTCTCTCCTCCAG | e-e-e-d$_{(10)}$-k-k-k | 68 | 719 |
| 1154 | 1169 | 528504 | ACGATTCTCTCCTCCA | e-e-e-d$_{(10)}$-k-k-k | 69 | 720 |
| 1155 | 1170 | 528505 | CACGATTCTCTCCTCC | e-e-e-d$_{(10)}$-k-k-k | 68 | 721 |
| 1156 | 1171 | 528506 | CCACGATTCTCTCCTC | e-e-e-d$_{(10)}$-k-k-k | 45 | 722 |
| 1157 | 1172 | 528507 | TCCACGATTCTCTCCT | e-e-e-d$_{(10)}$-k-k-k | 42 | 723 |
| 1158 | 1173 | 528508 | CTCCACGATTCTCTCC | e-e-e-d$_{(10)}$-k-k-k | 41 | 724 |
| 1159 | 1174 | 528509 | GCTCCACGATTCTCTC | e-e-e-d$_{(10)}$-k-k-k | 32 | 725 |
| 1160 | 1175 | 528510 | AGCTCCACGATTCTCT | e-e-e-d$_{(10)}$-k-k-k | 7 | 726 |
| 1161 | 1176 | 528511 | CAGCTCCACGATTCTC | e-e-e-d$_{(10)}$-k-k-k | 5 | 727 |
| 1162 | 1177 | 528512 | ACAGCTCCACGATTCT | e-e-e-d$_{(10)}$-k-k-k | 0 | 728 |
| 1163 | 1178 | 528513 | AACAGCTCCACGATTC | e-e-e-d$_{(10)}$-k-k-k | 8 | 729 |
| 1184 | 1199 | 528514 | GCACTTTTCATTAAGT | e-e-e-d$_{(10)}$-k-k-k | 14 | 730 |
| 1185 | 1200 | 528515 | GGCACTTTTCATTAAG | e-e-e-d$_{(10)}$-k-k-k | 15 | 731 |
| 1199 | 1214 | 528516 | CGCTCCACCACAAAGG | e-e-e-d$_{(10)}$-k-k-k | 46 | 732 |
| 1205 | 1220 | 528517 | GGCTGCCGCTCCACCA | e-e-e-d$_{(10)}$-k-k-k | 55 | 733 |
| 1206 | 1221 | 528518 | GGGCTGCCGCTCCACC | e-e-e-d$_{(10)}$-k-k-k | 80 | 734 |
| 1207 | 1222 | 528519 | AGGGCTGCCGCTCCAC | e-e-e-d$_{(10)}$-k-k-k | 61 | 735 |
| 1208 | 1223 | 528520 | CAGGGCTGCCGCTCCA | e-e-e-d$_{(10)}$-k-k-k | 63 | 736 |
| 1211 | 1226 | 528521 | ATGCAGGGCTGCCGCT | e-e-e-d$_{(10)}$-k-k-k | 37 | 737 |
| 1212 | 1227 | 528522 | CATGCAGGGCTGCCGC | e-e-e-d$_{(10)}$-k-k-k | 38 | 738 |
| 1221 | 1236 | 528523 | ATGCATGGGCATGCAG | e-e-e-d$_{(10)}$-k-k-k | 26 | 739 |
| 1222 | 1237 | 528524 | GATGCATGGGCATGCA | e-e-e-d$_{(10)}$-k-k-k | 42 | 740 |

TABLE 11-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 1223 | 1238 | 528525 | GGATGCATGGGCATGC | e-e-e-d$_{(10)}$-k-k-k | 43 | 741 |
| 1252 | 1267 | 528526 | CGCCGGTCTTGATGAC | e-e-e-d$_{(10)}$-k-k-k | 11 | 742 |
| 1253 | 1268 | 528527 | ACGCCGGTCTTGATGA | e-e-e-d$_{(10)}$-k-k-k | 0 | 743 |
| 1265 | 1280 | 528528 | GTAGTGAACTGGACGC | e-e-e-d$_{(10)}$-k-k-k | 10 | 744 |
| 1284 | 1299 | 528529 | GACCAGCAACCTGACT | e-e-e-d$_{(10)}$-k-k-k | 22 | 745 |
| 1285 | 1300 | 528530 | TGACCAGCAACCTGAC | e-e-e-d$_{(10)}$-k-k-k | 31 | 746 |
| 1288 | 1303 | 528531 | ATTTGACCAGCAACCT | e-e-e-d$_{(10)}$-k-k-k | 48 | 747 |
| 1289 | 1304 | 528532 | AATTTGACCAGCAACC | e-e-e-d$_{(10)}$-k-k-k | 22 | 748 |
| 1290 | 1305 | 528533 | GAATTTGACCAGCAAC | e-e-e-d$_{(10)}$-k-k-k | 11 | 749 |
| 1293 | 1308 | 528534 | AGGGAATTTGACCAGC | e-e-e-d$_{(10)}$-k-k-k | 67 | 750 |
| 1294 | 1309 | 528535 | CAGGGAATTTGACCAG | e-e-e-d$_{(10)}$-k-k-k | 50 | 751 |
| 1295 | 1310 | 528536 | TCAGGGAATTTGACCA | e-e-e-d$_{(10)}$-k-k-k | 38 | 752 |
| 1296 | 1311 | 528537 | CTCAGGGAATTTGACC | e-e-e-d$_{(10)}$-k-k-k | 17 | 753 |
| 1336 | 1351 | 528539 | CTTTGTCAATGCACAC | e-e-e-d$_{(10)}$-k-k-k | 67 | 754 |
| 1338 | 1353 | 528540 | GTCTTTGTCAATGCAC | e-e-e-d$_{(10)}$-k-k-k | 61 | 755 |
| 1339 | 1354 | 528541 | AGTCTTTGTCAATGCA | e-e-e-d$_{(10)}$-k-k-k | 65 | 756 |
| 1343 | 1358 | 528542 | CCAGAGTCTTTGTCAA | e-e-e-d$_{(10)}$-k-k-k | 10 | 757 |
| 1345 | 1360 | 528543 | CCCCAGAGTCTTTGTC | e-e-e-d$_{(10)}$-k-k-k | 7 | 758 |
| 1371 | 1386 | 528544 | CCGGGATCCTCTGAGA | e-e-e-d$_{(10)}$-k-k-k | 12 | 759 |
| 1372 | 1387 | 528545 | TCCGGGATCCTCTGAG | e-e-e-d$_{(10)}$-k-k-k | 11 | 760 |
| 1373 | 1388 | 528546 | TTCCGGGATCCTCTGA | e-e-e-d$_{(10)}$-k-k-k | 7 | 761 |
| 1374 | 1389 | 528547 | TTTCCGGGATCCTCTG | e-e-e-d$_{(10)}$-k-k-k | 14 | 762 |
| 1375 | 1390 | 528548 | ATTTCCGGGATCCTCT | e-e-e-d$_{(10)}$-k-k-k | 14 | 763 |
| 1376 | 1391 | 528549 | AATTTCCGGGATCCTC | e-e-e-d$_{(10)}$-k-k-k | 19 | 764 |
| 1377 | 1392 | 528550 | AAATTTCCGGGATCCT | e-e-e-d$_{(10)}$-k-k-k | 14 | 765 |
| 1379 | 1394 | 528551 | TTAAATTTCCGGGATC | e-e-e-d$_{(10)}$-k-k-k | 1 | 766 |
| 1380 | 1395 | 528552 | GTTAAATTTCCGGGAT | e-e-e-d$_{(10)}$-k-k-k | 9 | 767 |
| 1381 | 1396 | 528553 | TGTTAAATTTCCGGGA | e-e-e-d$_{(10)}$-k-k-k | 0 | 768 |
| 1382 | 1397 | 528554 | ATGTTAAATTTCCGGG | e-e-e-d$_{(10)}$-k-k-k | 12 | 769 |
| 1384 | 1399 | 528555 | GAATGTTAAATTTCCG | e-e-e-d$_{(10)}$-k-k-k | 13 | 770 |
| 1392 | 1407 | 528556 | TGTGCCCAGAATGTTA | e-e-e-d$_{(10)}$-k-k-k | 18 | 771 |
| 1435 | 1450 | 528557 | GGCTGCCGTTGTTGGA | e-e-e-d$_{(10)}$-k-k-k | 48 | 772 |
| 1436 | 1451 | 528558 | AGGCTGCCGTTGTTGG | e-e-e-d$_{(10)}$-k-k-k | 38 | 773 |
| 1437 | 1452 | 528559 | GAGGCTGCCGTTGTTG | e-e-e-d$_{(10)}$-k-k-k | 24 | 98 |
| 1438 | 1453 | 528560 | AGAGGCTGCCGTTGTT | e-e-e-d$_{(10)}$-k-k-k | 27 | 774 |
| 1439 | 1454 | 528561 | GAGAGGCTGCCGTTGT | e-e-e-d$_{(10)}$-k-k-k | 10 | 775 |

TABLE 11-continued

Inhibition of human STAT3 mRNA levels by chimeric antisense oligonuclotides targeted to SEQ ID NO: 1

| Human Start Site | Human Stop Site | ISIS No | Sequence | Chemistry | % inhibition | SEQ ID NO |
|---|---|---|---|---|---|---|
| 1440 | 1455 | 528562 | AGAGAGGCTGCCGTTG | e-e-e-d$_{(10)}$-k-k-k | 17 | 776 |
| 1441 | 1456 | 528563 | CAGAGAGGCTGCCGTT | e-e-e-d$_{(10)}$-k-k-k | 27 | 777 |
| 1461 | 1476 | 528564 | GGTCAAGTGTTTGAAT | e-e-e-d$_{(10)}$-k-k-k | 7 | 778 |
| 1471 | 1486 | 528565 | GCTCCCTCAGGGTCAA | e-e-e-d$_{(10)}$-k-k-k | 48 | 779 |
| 1496 | 1511 | 528566 | GCTCGGCCCCATTCC | e-e-e-d$_{(10)}$-k-k-k | 42 | 780 |
| 1497 | 1512 | 528567 | GGCTCGGCCCCCATTC | e-e-e-d$_{(10)}$-k-k-k | 45 | 781 |
| 1498 | 1513 | 528568 | TGGCTCGGCCCCCATT | e-e-e-d$_{(10)}$-k-k-k | 34 | 782 |
| 1499 | 1514 | 528569 | TTGGCTCGGCCCCCAT | e-e-e-d$_{(10)}$-k-k-k | 49 | 783 |
| 1517 | 1532 | 528570 | ATCAGGGAAGCATCAC | e-e-e-d$_{(10)}$-k-k-k | 22 | 104 |
| 1519 | 1534 | 528571 | CAATCAGGGAAGCATC | e-e-e-d$_{(10)}$-k-k-k | 13 | 784 |
| 1523 | 1538 | 528572 | GTCACAATCAGGGAAG | e-e-e-d$_{(10)}$-k-k-k | 30 | 785 |
| 1525 | 1540 | 528573 | CAGTCACAATCAGGGA | e-e-e-d$_{(10)}$-k-k-k | 27 | 786 |
| 1526 | 1541 | 528574 | TCAGTCACAATCAGGG | e-e-e-d$_{(10)}$-k-k-k | 51 | 787 |
| 1529 | 1544 | 528575 | TCCTCAGTCACAATCA | e-e-e-d$_{(10)}$-k-k-k | 14 | 788 |
| 1537 | 1552 | 528576 | GGTGCAGCTCCTCAGT | e-e-e-d$_{(10)}$-k-k-k | 28 | 789 |
| 1543 | 1558 | 528577 | TGATCAGGTGCAGCTC | e-e-e-d$_{(10)}$-k-k-k | 30 | 790 |
| 1544 | 1559 | 528578 | GTGATCAGGTGCAGCT | e-e-e-d$_{(10)}$-k-k-k | 36 | 791 |
| 1545 | 1560 | 528579 | GGTGATCAGGTGCAGC | e-e-e-d$_{(10)}$-k-k-k | 39 | 792 |
| 1576 | 1591 | 528580 | TGAGGCCTTGGTGATA | e-e-e-d$_{(10)}$-k-k-k | 10 | 793 |
| 1578 | 1593 | 528581 | CTTGAGGCCTTGGTGA | e-e-e-d$_{(10)}$-k-k-k | 5 | 794 |
| 1579 | 1594 | 528582 | TCTTGAGGCCTTGGTG | e-e-e-d$_{(10)}$-k-k-k | 15 | 110 |
| 1580 | 1595 | 528583 | ATCTTGAGGCCTTGGT | e-e-e-d$_{(10)}$-k-k-k | 5 | 795 |
| 1581 | 1596 | 528584 | AATCTTGAGGCCTTGG | e-e-e-d$_{(10)}$-k-k-k | 15 | 796 |
| 1582 | 1597 | 528585 | CAATCTTGAGGCCTTG | e-e-e-d$_{(10)}$-k-k-k | 7 | 797 |
| 1583 | 1598 | 528586 | TCAATCTTGAGGCCTT | e-e-e-d$_{(10)}$-k-k-k | 9 | 798 |
| 1584 | 1599 | 528587 | GTCAATCTTGAGGCCT | e-e-e-d$_{(10)}$-k-k-k | 25 | 799 |
| 1585 | 1600 | 528588 | GGTCAATCTTGAGGCC | e-e-e-d$_{(10)}$-k-k-k | 26 | 800 |
| 1586 | 1601 | 528589 | AGGTCAATCTTGAGGC | e-e-e-d$_{(10)}$-k-k-k | 31 | 801 |
| 1587 | 1602 | 528590 | TAGGTCAATCTTGAGG | e-e-e-d$_{(10)}$-k-k-k | 27 | 802 |
| 1588 | 1603 | 528591 | CTAGGTCAATCTTGAG | e-e-e-d$_{(10)}$-k-k-k | 24 | 803 |
| 1590 | 1605 | 528592 | CTCTAGGTCAATCTTG | e-e-e-d$_{(10)}$-k-k-k | 33 | 804 |
| 1592 | 1607 | 528593 | GTCTCTAGGTCAATCT | e-e-e-d$_{(10)}$-k-k-k | 30 | 805 |
| 1594 | 1609 | 528594 | GGGTCTCTAGGTCAAT | e-e-e-d$_{(10)}$-k-k-k | 25 | 806 |
| 1595 | 1610 | 528595 | TGGGTCTCTAGGTCAA | e-e-e-d$_{(10)}$-k-k-k | 28 | 807 |
| 1596 | 1611 | 528596 | GTGGGTCTCTAGGTCA | e-e-e-d$_{(10)}$-k-k-k | 34 | 808 |
| 1597 | 1612 | 528597 | AGTGGGTCTCTAGGTC | e-e-e-d$_{(10)}$-k-k-k | 19 | 809 |
| 1599 | 1614 | 528598 | GGAGTGGGTCTCTAGG | e-e-e-d$_{(10)}$-k-k-k | 31 | 114 |

TABLE 11-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 1600 | 1615 | 528599 | AGGAGTGGGTCTCTAG | e-e-e-d$_{(10)}$-k-k-k | 10 | 810 |
| 1601 | 1616 | 528600 | AAGGAGTGGGTCTCTA | e-e-e-d$_{(10)}$-k-k-k | 14 | 811 |
| 1602 | 1617 | 528601 | CAAGGAGTGGGTCTCT | e-e-e-d$_{(10)}$-k-k-k | 11 | 812 |
| 1609 | 1624 | 528602 | CAACTGGCAAGGAGTG | e-e-e-d$_{(10)}$-k-k-k | 17 | 813 |
| 1629 | 1644 | 528603 | ACAGATGTTGGAGATC | e-e-e-d$_{(10)}$-k-k-k | 8 | 814 |
| 1632 | 1647 | 528604 | CTGACAGATGTTGGAG | e-e-e-d$_{(10)}$-k-k-k | 11 | 815 |
| 1633 | 1648 | 528605 | TCTGACAGATGTTGGA | e-e-e-d$_{(10)}$-k-k-k | 25 | 119 |
| 1650 | 1665 | 528606 | CGCCCAGGCATTTGGC | e-e-e-d$_{(10)}$-k-k-k | 18 | 816 |
| 1651 | 1666 | 528607 | ACGCCCAGGCATTTGG | e-e-e-d$_{(10)}$-k-k-k | 36 | 817 |
| 1677 | 1692 | 528608 | GGTCAGCATGTTGTAC | e-e-e-d$_{(10)}$-k-k-k | 11 | 818 |
| 1678 | 1693 | 528609 | TGGTCAGCATGTTGTA | e-e-e-d$_{(10)}$-k-k-k | 9 | 819 |
| 1680 | 1695 | 528610 | GTTGGTCAGCATGTTG | e-e-e-d$_{(10)}$-k-k-k | 19 | 820 |
| 1682 | 1697 | 528611 | TTGTTGGTCAGCATGT | e-e-e-d$_{(10)}$-k-k-k | 27 | 821 |
| 1711 | 1726 | 528612 | GCTTGGTAAAAAAGTT | e-e-e-d$_{(10)}$-k-k-k | 0 | 822 |
| 1712 | 1727 | 528613 | GGCTTGGTAAAAAAGT | e-e-e-d$_{(10)}$-k-k-k | 0 | 823 |
| 1713 | 1728 | 528614 | GGGCTTGGTAAAAAAG | e-e-e-d$_{(10)}$-k-k-k | 0 | 824 |
| 1736 | 1751 | 528615 | ACTTGATCCCAGGTTC | e-e-e-d$_{(10)}$-k-k-k | 26 | 825 |
| 1741 | 1756 | 528616 | CGGCCACTTGATCCCA | e-e-e-d$_{(10)}$-k-k-k | 41 | 826 |
| 1742 | 1757 | 528617 | TCGGCCACTTGATCCC | e-e-e-d$_{(10)}$-k-k-k | 40 | 827 |
| 1743 | 1758 | 528618 | CTCGGCCACTTGATCC | e-e-e-d$_{(10)}$-k-k-k | 27 | 828 |
| 1744 | 1759 | 528619 | CCTCGGCCACTTGATC | e-e-e-d$_{(10)}$-k-k-k | 10 | 829 |
| 1745 | 1760 | 528620 | ACCTCGGCCACTTGAT | e-e-e-d$_{(10)}$-k-k-k | 16 | 830 |
| 1746 | 1761 | 528621 | GACCTCGGCCACTTGA | e-e-e-d$_{(10)}$-k-k-k | 31 | 831 |
| 1747 | 1762 | 528622 | GGACCTCGGCCACTTG | e-e-e-d$_{(10)}$-k-k-k | 59 | 832 |
| 1748 | 1763 | 528623 | AGGACCTCGGCCACTT | e-e-e-d$_{(10)}$-k-k-k | 49 | 833 |
| 1749 | 1764 | 528624 | CAGGACCTCGGCCACT | e-e-e-d$_{(10)}$-k-k-k | 32 | 834 |
| 1753 | 1768 | 528625 | AGCTCAGGACCTCGGC | e-e-e-d$_{(10)}$-k-k-k | 28 | 835 |
| 1754 | 1769 | 528626 | CAGCTCAGGACCTCGG | e-e-e-d$_{(10)}$-k-k-k | 58 | 836 |
| 1755 | 1770 | 528627 | CCAGCTCAGGACCTCG | e-e-e-d$_{(10)}$-k-k-k | 56 | 837 |
| 1778 | 1793 | 528628 | CGCTTGGTGGTGGAGG | e-e-e-d$_{(10)}$-k-k-k | 15 | 838 |
| 1779 | 1794 | 528629 | TCGCTTGGTGGTGGAG | e-e-e-d$_{(10)}$-k-k-k | 9 | 839 |
| 1780 | 1795 | 528630 | CTCGCTTGGTGGTGGA | e-e-e-d$_{(10)}$-k-k-k | 14 | 127 |
| 1781 | 1796 | 528631 | CCTCGCTTGGTGGTGG | e-e-e-d$_{(10)}$-k-k-k | 26 | 840 |
| 1782 | 1797 | 528632 | TCCTCGCTTGGTGGTG | e-e-e-d$_{(10)}$-k-k-k | 24 | 841 |
| 1783 | 1798 | 528633 | GTCCTCGCTTGGTGGT | e-e-e-d$_{(10)}$-k-k-k | 40 | 842 |
| 1784 | 1799 | 528634 | AGTCCTCGCTTGGTGG | e-e-e-d$_{(10)}$-k-k-k | 38 | 843 |

TABLE 11-continued

Inhibition of human STAT3 mRNA levels by chimeric antisense oligonuclotides targeted to SEQ ID NO: 1

| Human Start Site | Human Stop Site | ISIS No | Sequence | Chemistry | % inhibition | SEQ ID NO |
|---|---|---|---|---|---|---|
| 1785 | 1800 | 528635 | CAGTCCTCGCTTGGTG | e-e-e-d$_{(10)}$-k-k-k | 20 | 844 |
| 1786 | 1801 | 528636 | TCAGTCCTCGCTTGGT | e-e-e-d$_{(10)}$-k-k-k | 23 | 845 |
| 1787 | 1802 | 528637 | CTCAGTCCTCGCTTGG | e-e-e-d$_{(10)}$-k-k-k | 33 | 846 |
| 1788 | 1803 | 528638 | GCTCAGTCCTCGCTTG | e-e-e-d$_{(10)}$-k-k-k | 15 | 847 |
| 1789 | 1804 | 528639 | TGCTCAGTCCTCGCTT | e-e-e-d$_{(10)}$-k-k-k | 15 | 848 |
| 1791 | 1806 | 528640 | GATGCTCAGTCCTCGC | e-e-e-d$_{(10)}$-k-k-k | 43 | 849 |
| 1792 | 1807 | 528641 | CGATGCTCAGTCCTCG | e-e-e-d$_{(10)}$-k-k-k | 46 | 850 |
| 1793 | 1808 | 528642 | TCGATGCTCAGTCCTC | e-e-e-d$_{(10)}$-k-k-k | 39 | 851 |
| 1794 | 1809 | 528643 | CTCGATGCTCAGTCCT | e-e-e-d$_{(10)}$-k-k-k | 32 | 852 |
| 1795 | 1810 | 528644 | GCTCGATGCTCAGTCC | e-e-e-d$_{(10)}$-k-k-k | 43 | 129 |
| 1796 | 1811 | 528645 | TGCTCGATGCTCAGTC | e-e-e-d$_{(10)}$-k-k-k | 22 | 853 |
| 1797 | 1812 | 528646 | CTGCTCGATGCTCAGT | e-e-e-d$_{(10)}$-k-k-k | 38 | 854 |
| 1799 | 1814 | 528647 | AGCTGCTCGATGCTCA | e-e-e-d$_{(10)}$-k-k-k | 40 | 855 |
| 1800 | 1815 | 528648 | CAGCTGCTCGATGCTC | e-e-e-d$_{(10)}$-k-k-k | 39 | 856 |
| 1802 | 1817 | 528649 | GTCAGCTGCTCGATGC | e-e-e-d$_{(10)}$-k-k-k | 32 | 857 |
| 1803 | 1818 | 528650 | AGTCAGCTGCTCGATG | e-e-e-d$_{(10)}$-k-k-k | 10 | 858 |
| 1804 | 1819 | 528651 | TAGTCAGCTGCTCGAT | e-e-e-d$_{(10)}$-k-k-k | 4 | 859 |
| 1805 | 1820 | 528652 | GTAGTCAGCTGCTCGA | e-e-e-d$_{(10)}$-k-k-k | 17 | 860 |
| 1806 | 1821 | 528653 | TGTAGTCAGCTGCTCG | e-e-e-d$_{(10)}$-k-k-k | 28 | 861 |
| 1807 | 1822 | 528654 | GTGTAGTCAGCTGCTC | e-e-e-d$_{(10)}$-k-k-k | 31 | 862 |
| 1808 | 1823 | 528655 | AGTGTAGTCAGCTGCT | e-e-e-d$_{(10)}$-k-k-k | 30 | 863 |
| 1809 | 1824 | 528656 | CAGTGTAGTCAGCTGC | e-e-e-d$_{(10)}$-k-k-k | 30 | 864 |
| 1810 | 1825 | 528657 | CCAGTGTAGTCAGCTG | e-e-e-d$_{(10)}$-k-k-k | 23 | 865 |
| 1811 | 1826 | 528658 | GCCAGTGTAGTCAGCT | e-e-e-d$_{(10)}$-k-k-k | 30 | 866 |
| 1832 | 1847 | 528659 | CCAGGTCCCAAGAGTT | e-e-e-d$_{(10)}$-k-k-k | 12 | 867 |
| 1852 | 1867 | 528660 | GACACCCTGAATAATT | e-e-e-d$_{(10)}$-k-k-k | 10 | 868 |
| 1853 | 1868 | 528661 | TGACACCCTGAATAAT | e-e-e-d$_{(10)}$-k-k-k | 10 | 869 |
| 1856 | 1871 | 528662 | ATCTGACACCCTGAAT | e-e-e-d$_{(10)}$-k-k-k | 12 | 870 |
| 1857 | 1872 | 528663 | GATCTGACACCCTGAA | e-e-e-d$_{(10)}$-k-k-k | 22 | 871 |
| 1859 | 1874 | 528664 | GTGATCTGACACCCTG | e-e-e-d$_{(10)}$-k-k-k | 61 | 872 |
| 1861 | 1876 | 528665 | ATGTGATCTGACACCC | e-e-e-d$_{(10)}$-k-k-k | 36 | 873 |
| 1865 | 1880 | 528666 | GCCCATGTGATCTGAC | e-e-e-d$_{(10)}$-k-k-k | 46 | 874 |
| 1866 | 1881 | 528667 | AGCCCATGTGATCTGA | e-e-e-d$_{(10)}$-k-k-k | 36 | 137 |
| 1867 | 1882 | 528668 | TAGCCCATGTGATCTG | e-e-e-d$_{(10)}$-k-k-k | 44 | 875 |
| 1869 | 1884 | 528669 | TTTAGCCCATGTGATC | e-e-e-d$_{(10)}$-k-k-k | 12 | 876 |
| 1907 | 1922 | 528670 | AAGGAGAAGCCCTTGC | e-e-e-d$_{(10)}$-k-k-k | 35 | 877 |
| 1925 | 1940 | 528671 | TTGTCCAGCCAGACCC | e-e-e-d$_{(10)}$-k-k-k | 40 | 878 |

TABLE 11-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 1926 | 1941 | 528672 | ATTGTCCAGCCAGACC | e-e-e-d$_{(10)}$-k-k-k | 36 | 879 |
| 1927 | 1942 | 528673 | TATTGTCCAGCCAGAC | e-e-e-d$_{(10)}$-k-k-k | 23 | 880 |
| 1928 | 1943 | 528674 | ATATTGTCCAGCCAGA | e-e-e-d$_{(10)}$-k-k-k | 24 | 881 |
| 1929 | 1944 | 528675 | GATATTGTCCAGCCAG | e-e-e-d$_{(10)}$-k-k-k | 52 | 882 |
| 1931 | 1946 | 528676 | ATGATATTGTCCAGCC | e-e-e-d$_{(10)}$-k-k-k | 41 | 883 |
| 1933 | 1948 | 528677 | CAATGATATTGTCCAG | e-e-e-d$_{(10)}$-k-k-k | 23 | 884 |
| 1935 | 1950 | 528678 | GTCAATGATATTGTCC | e-e-e-d$_{(10)}$-k-k-k | 32 | 885 |
| 1936 | 1951 | 528679 | GGTCAATGATATTGTC | e-e-e-d$_{(10)}$-k-k-k | 26 | 886 |
| 1941 | 1956 | 528680 | CACAAGGTCAATGATA | e-e-e-d$_{(10)}$-k-k-k | 5 | 887 |
| 1942 | 1957 | 528681 | TCACAAGGTCAATGAT | e-e-e-d$_{(10)}$-k-k-k | 9 | 888 |
| 1948 | 1963 | 518340 | ACTTTTTCACAAGGTC | e-e-e-d$_{(10)}$-k-k-k | 52 | 153 |
| 1950 | 1965 | 528682 | GTACTTTTTCACAAGG | e-e-e-d$_{(10)}$-k-k-k | 21 | 889 |
| 1954 | 1969 | 528683 | GGATGTACTTTTTCAC | e-e-e-d$_{(10)}$-k-k-k | 0 | 890 |
| 1958 | 1973 | 528684 | GCCAGGATGTACTTTT | e-e-e-d$_{(10)}$-k-k-k | 0 | 891 |
| 1962 | 1977 | 528685 | AAGGGCCAGGATGTAC | e-e-e-d$_{(10)}$-k-k-k | 0 | 892 |
| 1963 | 1978 | 528686 | AAAGGGCCAGGATGTA | e-e-e-d$_{(10)}$-k-k-k | 0 | 893 |
| 2004 | 2019 | 528687 | CCGCTCCTTACTGATA | e-e-e-d$_{(10)}$-k-k-k | 21 | 894 |
| 2010 | 2025 | 528688 | CCGCTCCCGCTCCTTA | e-e-e-d$_{(10)}$-k-k-k | 32 | 895 |
| 2014 | 2029 | 528689 | TGGCCCGCTCCCGCTC | e-e-e-d$_{(10)}$-k-k-k | 52 | 896 |
| 2015 | 2030 | 528690 | ATGGCCCGCTCCCGCT | e-e-e-d$_{(10)}$-k-k-k | 41 | 897 |
| 2017 | 2032 | 528691 | AGATGGCCCGCTCCCG | e-e-e-d$_{(10)}$-k-k-k | 51 | 898 |
| 2018 | 2033 | 528692 | AAGATGGCCCGCTCCC | e-e-e-d$_{(10)}$-k-k-k | 45 | 899 |
| 2019 | 2034 | 528693 | CAAGATGGCCCGCTCC | e-e-e-d$_{(10)}$-k-k-k | 46 | 900 |
| 2020 | 2035 | 528694 | TCAAGATGGCCCGCTC | e-e-e-d$_{(10)}$-k-k-k | 27 | 901 |
| 2022 | 2037 | 528695 | GCTCAAGATGGCCCGC | e-e-e-d$_{(10)}$-k-k-k | 54 | 902 |
| 2023 | 2038 | 528696 | TGCTCAAGATGGCCCG | e-e-e-d$_{(10)}$-k-k-k | 46 | 903 |
| 2024 | 2039 | 528697 | GTGCTCAAGATGGCCC | e-e-e-d$_{(10)}$-k-k-k | 60 | 904 |
| 2041 | 2056 | 528698 | AGGTGCCTGGAGGCTT | e-e-e-d$_{(10)}$-k-k-k | 17 | 905 |
| 2093 | 2108 | 528699 | CAAGTGAAAGTGACGC | e-e-e-d$_{(10)}$-k-k-k | 2 | 161 |
| 2094 | 2109 | 528700 | CCAAGTGAAAGTGACG | e-e-e-d$_{(10)}$-k-k-k | 13 | 906 |
| 2095 | 2110 | 528701 | CCCAAGTGAAAGTGAC | e-e-e-d$_{(10)}$-k-k-k | 14 | 907 |
| 2128 | 2143 | 528702 | GGATCTGGGTCTTACC | e-e-e-d$_{(10)}$-k-k-k | 22 | 908 |
| 2129 | 2144 | 528703 | TGGATCTGGGTCTTAC | e-e-e-d$_{(10)}$-k-k-k | 22 | 909 |
| 2131 | 2146 | 528704 | ACTGGATCTGGGTCTT | e-e-e-d$_{(10)}$-k-k-k | 21 | 165 |
| 2133 | 2148 | 528705 | GGACTGGATCTGGGTC | e-e-e-d$_{(10)}$-k-k-k | 38 | 910 |
| 2138 | 2153 | 528706 | TCCACGGACTGGATCT | e-e-e-d$_{(10)}$-k-k-k | 13 | 911 |

TABLE 11-continued

Inhibition of human STAT3 mRNA levels by chimeric antisense oligonuclotides targeted to SEQ ID NO: 1

| Human Start Site | Human Stop Site | ISIS No | Sequence | Chemistry | % inhibition | SEQ ID NO |
|---|---|---|---|---|---|---|
| 2139 | 2154 | 528707 | TTCCACGGACTGGATC | e-e-e-d$_{(10)}$-k-k-k | 19 | 912 |
| 2140 | 2155 | 528708 | GTTCCACGGACTGGAT | e-e-e-d$_{(10)}$-k-k-k | 2 | 913 |
| 2141 | 2156 | 528709 | GGTTCCACGGACTGGA | e-e-e-d$_{(10)}$-k-k-k | 42 | 914 |
| 2142 | 2157 | 528710 | TGGTTCCACGGACTGG | e-e-e-d$_{(10)}$-k-k-k | 63 | 915 |
| 2143 | 2158 | 528711 | ATGGTTCCACGGACTG | e-e-e-d$_{(10)}$-k-k-k | 62 | 916 |
| 2144 | 2159 | 528712 | TATGGTTCCACGGACT | e-e-e-d$_{(10)}$-k-k-k | 35 | 917 |
| 2146 | 2161 | 528713 | TGTATGGTTCCACGGA | e-e-e-d$_{(10)}$-k-k-k | 40 | 918 |
| 2147 | 2162 | 528714 | GTGTATGGTTCCACGG | e-e-e-d$_{(10)}$-k-k-k | 48 | 919 |
| 2193 | 2208 | 528715 | GCCCATGATGATTTCA | e-e-e-d$_{(10)}$-k-k-k | 36 | 920 |
| 2194 | 2209 | 528716 | AGCCCATGATGATTTC | e-e-e-d$_{(10)}$-k-k-k | 25 | 921 |
| 2195 | 2210 | 528717 | TAGCCCATGATGATTT | e-e-e-d$_{(10)}$-k-k-k | 27 | 922 |
| 2196 | 2211 | 528718 | ATAGCCCATGATGATT | e-e-e-d$_{(10)}$-k-k-k | 19 | 923 |
| 2197 | 2212 | 528719 | TATAGCCCATGATGAT | e-e-e-d$_{(10)}$-k-k-k | 14 | 924 |
| 2198 | 2213 | 528720 | TTATAGCCCATGATGA | e-e-e-d$_{(10)}$-k-k-k | 14 | 925 |
| 2199 | 2214 | 528721 | CTTATAGCCCATGATG | e-e-e-d$_{(10)}$-k-k-k | 21 | 926 |
| 2200 | 2215 | 528722 | TCTTATAGCCCATGAT | e-e-e-d$_{(10)}$-k-k-k | 0 | 927 |
| 2201 | 2216 | 528723 | ATCTTATAGCCCATGA | e-e-e-d$_{(10)}$-k-k-k | 17 | 928 |
| 2202 | 2217 | 528724 | GATCTTATAGCCCATG | e-e-e-d$_{(10)}$-k-k-k | 35 | 929 |
| 2203 | 2218 | 528725 | TGATCTTATAGCCCAT | e-e-e-d$_{(10)}$-k-k-k | 45 | 930 |
| 2204 | 2219 | 528726 | ATGATCTTATAGCCCA | e-e-e-d$_{(10)}$-k-k-k | 67 | 931 |
| 2205 | 2220 | 528727 | CATGATCTTATAGCCC | e-e-e-d$_{(10)}$-k-k-k | 45 | 932 |
| 2206 | 2221 | 528728 | CCATGATCTTATAGCC | e-e-e-d$_{(10)}$-k-k-k | 38 | 175 |
| 2207 | 2222 | 528729 | TCCATGATCTTATAGC | e-e-e-d$_{(10)}$-k-k-k | 0 | 933 |
| 2208 | 2223 | 528730 | ATCCATGATCTTATAG | e-e-e-d$_{(10)}$-k-k-k | 12 | 934 |
| 2213 | 2228 | 528731 | GTAGCATCCATGATCT | e-e-e-d$_{(10)}$-k-k-k | 14 | 935 |
| 2214 | 2229 | 528732 | GGTAGCATCCATGATC | e-e-e-d$_{(10)}$-k-k-k | 25 | 936 |
| 2217 | 2232 | 528733 | ATTGGTAGCATCCATG | e-e-e-d$_{(10)}$-k-k-k | 22 | 937 |
| 2218 | 2233 | 528734 | TATTGGTAGCATCCAT | e-e-e-d$_{(10)}$-k-k-k | 15 | 938 |
| 2219 | 2234 | 528735 | ATATTGGTAGCATCCA | e-e-e-d$_{(10)}$-k-k-k | 28 | 939 |
| 2264 | 2279 | 528736 | TCCTTGGGAATGTCAG | e-e-e-d$_{(10)}$-k-k-k | 30 | 940 |
| 2266 | 2281 | 528737 | CCTCCTTGGGAATGTC | e-e-e-d$_{(10)}$-k-k-k | 30 | 181 |
| 2275 | 2290 | 528738 | CGAATGCCTCCTCCTT | e-e-e-d$_{(10)}$-k-k-k | 29 | 186 |
| 2277 | 2292 | 528739 | TCCGAATGCCTCCTCC | e-e-e-d$_{(10)}$-k-k-k | 33 | 941 |
| 2278 | 2293 | 528740 | TTCCGAATGCCTCCTC | e-e-e-d$_{(10)}$-k-k-k | 27 | 942 |
| 2279 | 2294 | 528741 | TTTCCGAATGCCTCCT | e-e-e-d$_{(10)}$-k-k-k | 20 | 943 |
| 2280 | 2295 | 528742 | CTTTCCGAATGCCTCC | e-e-e-d$_{(10)}$-k-k-k | 25 | 944 |
| 2281 | 2296 | 528743 | ACTTTCCGAATGCCTC | e-e-e-d$_{(10)}$-k-k-k | 39 | 945 |

TABLE 11-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 2283 | 2298 | 528744 | ATACTTTCCGAATGCC | e-e-e-d$_{(10)}$-k-k-k | 44 | 946 |
| 2285 | 2300 | 528745 | CAATACTTTCCGAATG | e-e-e-d$_{(10)}$-k-k-k | 0 | 947 |
| 2286 | 2301 | 528746 | ACAATACTTTCCGAAT | e-e-e-d$_{(10)}$-k-k-k | 0 | 948 |
| 2288 | 2303 | 528747 | CGACAATACTTTCCGA | e-e-e-d$_{(10)}$-k-k-k | 11 | 949 |
| 2289 | 2304 | 528748 | CCGACAATACTTTCCG | e-e-e-d$_{(10)}$-k-k-k | 31 | 950 |
| 2290 | 2305 | 528749 | GCCGACAATACTTTCC | e-e-e-d$_{(10)}$-k-k-k | 18 | 951 |
| 2291 | 2306 | 528750 | GGCCGACAATACTTTC | e-e-e-d$_{(10)}$-k-k-k | 16 | 952 |
| 2293 | 2308 | 528751 | CTGGCCGACAATACTT | e-e-e-d$_{(10)}$-k-k-k | 18 | 953 |
| 2294 | 2309 | 528752 | TCTGGCCGACAATACT | e-e-e-d$_{(10)}$-k-k-k | 8 | 954 |
| 2295 | 2310 | 528753 | CTCTGGCCGACAATAC | e-e-e-d$_{(10)}$-k-k-k | 0 | 955 |
| 2296 | 2311 | 528754 | TCTCTGGCCGACAATA | e-e-e-d$_{(10)}$-k-k-k | 6 | 188 |
| 2297 | 2312 | 528755 | CTCTCTGGCCGACAAT | e-e-e-d$_{(10)}$-k-k-k | 18 | 956 |
| 2298 | 2313 | 528756 | GCTCTCTGGCCGACAA | e-e-e-d$_{(10)}$-k-k-k | 35 | 957 |
| 2299 | 2314 | 528757 | GGCTCTCTGGCCGACA | e-e-e-d$_{(10)}$-k-k-k | 57 | 958 |
| 2300 | 2315 | 528758 | TGGCTCTCTGGCCGAC | e-e-e-d$_{(10)}$-k-k-k | 64 | 959 |
| 2301 | 2316 | 528759 | CTGGCTCTCTGGCCGA | e-e-e-d$_{(10)}$-k-k-k | 12 | 960 |
| 2326 | 2341 | 528760 | TACCTGGGTCAGCTTC | e-e-e-d$_{(10)}$-k-k-k | 21 | 961 |
| 2328 | 2343 | 528761 | GCTACCTGGGTCAGCT | e-e-e-d$_{(10)}$-k-k-k | 18 | 962 |
| 2329 | 2344 | 528762 | CGCTACCTGGGTCAGC | e-e-e-d$_{(10)}$-k-k-k | 28 | 963 |
| 2330 | 2345 | 528763 | GCGCTACCTGGGTCAG | e-e-e-d$_{(10)}$-k-k-k | 26 | 964 |
| 2349 | 2364 | 528764 | GGTCTTCAGGTATGGG | e-e-e-d$_{(10)}$-k-k-k | 38 | 965 |
| 2350 | 2365 | 528765 | TGGTCTTCAGGTATGG | e-e-e-d$_{(10)}$-k-k-k | 12 | 966 |
| 2352 | 2367 | 528766 | CTTGGTCTTCAGGTAT | e-e-e-d$_{(10)}$-k-k-k | 0 | 967 |
| 2353 | 2368 | 528767 | ACTTGGTCTTCAGGTA | e-e-e-d$_{(10)}$-k-k-k | 10 | 190 |
| 2358 | 2373 | 528768 | GATAAACTTGGTCTTC | e-e-e-d$_{(10)}$-k-k-k | 9 | 968 |
| 2360 | 2375 | 528769 | CAGATAAACTTGGTCT | e-e-e-d$_{(10)}$-k-k-k | 15 | 969 |
| 2361 | 2376 | 528770 | ACAGATAAACTTGGTC | e-e-e-d$_{(10)}$-k-k-k | 7 | 970 |
| 2369 | 2384 | 528771 | GGTGTCACACAGATAA | e-e-e-d$_{(10)}$-k-k-k | 35 | 971 |
| 2373 | 2388 | 528772 | CGTTGGTGTCACACAG | e-e-e-d$_{(10)}$-k-k-k | 52 | 972 |
| 2387 | 2402 | 528773 | GTATTGCTGCAGGTCG | e-e-e-d$_{(10)}$-k-k-k | 49 | 194 |
| 2388 | 2403 | 528774 | GGTATTGCTGCAGGTC | e-e-e-d$_{(10)}$-k-k-k | 48 | 973 |
| 2389 | 2404 | 528775 | TGGTATTGCTGCAGGT | e-e-e-d$_{(10)}$-k-k-k | 35 | 974 |
| 2390 | 2405 | 528776 | ATGGTATTGCTGCAGG | e-e-e-d$_{(10)}$-k-k-k | 20 | 975 |
| 2392 | 2407 | 528777 | CAATGGTATTGCTGCA | e-e-e-d$_{(10)}$-k-k-k | 24 | 976 |
| 2393 | 2408 | 528778 | TCAATGGTATTGCTGC | e-e-e-d$_{(10)}$-k-k-k | 15 | 977 |
| 2394 | 2409 | 528779 | GTCAATGGTATTGCTG | e-e-e-d$_{(10)}$-k-k-k | 16 | 978 |

TABLE 11-continued

Inhibition of human STAT3 mRNA levels by chimeric antisense oligonuclotides targeted to SEQ ID NO: 1

| Human Start Site | Human Stop Site | ISIS No | Sequence | Chemistry | % inhibition | SEQ ID NO |
|---|---|---|---|---|---|---|
| 2395 | 2410 | 528780 | GGTCAATGGTATTGCT | e-e-e-d$_{(10)}$-k-k-k | 34 | 196 |
| 2396 | 2411 | 528781 | AGGTCAATGGTATTGC | e-e-e-d$_{(10)}$-k-k-k | 26 | 979 |
| 2397 | 2412 | 528782 | CAGGTCAATGGTATTG | e-e-e-d$_{(10)}$-k-k-k | 16 | 980 |
| 2398 | 2413 | 528783 | GCAGGTCAATGGTATT | e-e-e-d$_{(10)}$-k-k-k | 10 | 981 |
| 2399 | 2414 | 528784 | GGCAGGTCAATGGTAT | e-e-e-d$_{(10)}$-k-k-k | 32 | 982 |
| 2400 | 2415 | 528785 | CGGCAGGTCAATGGTA | e-e-e-d$_{(10)}$-k-k-k | 39 | 983 |
| 2401 | 2416 | 528786 | TCGGCAGGTCAATGGT | e-e-e-d$_{(10)}$-k-k-k | 51 | 984 |
| 2403 | 2418 | 528787 | CATCGGCAGGTCAATG | e-e-e-d$_{(10)}$-k-k-k | 26 | 198 |
| 2404 | 2419 | 528788 | ACATCGGCAGGTCAAT | e-e-e-d$_{(10)}$-k-k-k | 20 | 985 |
| 2405 | 2420 | 528789 | GACATCGGCAGGTCAA | e-e-e-d$_{(10)}$-k-k-k | 42 | 986 |
| 2406 | 2421 | 528790 | GGACATCGGCAGGTCA | e-e-e-d$_{(10)}$-k-k-k | 58 | 987 |
| 2407 | 2422 | 528791 | GGGACATCGGCAGGTC | e-e-e-d$_{(10)}$-k-k-k | 68 | 988 |
| 2423 | 2438 | 528792 | GAATCTAAAGTGCGGG | e-e-e-d$_{(10)}$-k-k-k | 46 | 200 |
| 2424 | 2439 | 528793 | TGAATCTAAAGTGCGG | e-e-e-d$_{(10)}$-k-k-k | 43 | 989 |
| 2427 | 2442 | 528794 | CAATGAATCTAAAGTG | e-e-e-d$_{(10)}$-k-k-k | 20 | 990 |
| 2462 | 2477 | 528795 | GGTTCAGCACCTTCAC | e-e-e-d$_{(10)}$-k-k-k | 13 | 991 |
| 2463 | 2478 | 528796 | GGGTTCAGCACCTTCA | e-e-e-d$_{(10)}$-k-k-k | 24 | 992 |
| 2464 | 2479 | 528797 | AGGGTTCAGCACCTTC | e-e-e-d$_{(10)}$-k-k-k | 23 | 993 |
| 2465 | 2480 | 528798 | GAGGGTTCAGCACCTT | e-e-e-d$_{(10)}$-k-k-k | 18 | 994 |
| 2466 | 2481 | 528799 | TGAGGGTTCAGCACCT | e-e-e-d$_{(10)}$-k-k-k | 24 | 995 |
| 2490 | 2505 | 528800 | GAGGGACTCAAACTGC | e-e-e-d$_{(10)}$-k-k-k | 28 | 996 |
| 2492 | 2507 | 528801 | GTGAGGGACTCAAACT | e-e-e-d$_{(10)}$-k-k-k | 22 | 997 |
| 2493 | 2508 | 528802 | GGTGAGGGACTCAAAC | e-e-e-d$_{(10)}$-k-k-k | 20 | 998 |
| 2494 | 2509 | 528803 | AGGTGAGGGACTCAAA | e-e-e-d$_{(10)}$-k-k-k | 13 | 999 |
| 2495 | 2510 | 528804 | AAGGTGAGGGACTCAA | e-e-e-d$_{(10)}$-k-k-k | 20 | 1000 |
| 2497 | 2512 | 528805 | CAAAGGTGAGGGACTC | e-e-e-d$_{(10)}$-k-k-k | 20 | 1001 |
| 2498 | 2513 | 528806 | TCAAAGGTGAGGGACT | e-e-e-d$_{(10)}$-k-k-k | 18 | 1002 |
| 2506 | 2521 | 528807 | ACTCCATGTCAAAGGT | e-e-e-d$_{(10)}$-k-k-k | 54 | 1003 |
| 2510 | 2525 | 528808 | GTCAACTCCATGTCAA | e-e-e-d$_{(10)}$-k-k-k | 39 | 1004 |
| 2511 | 2526 | 528809 | GGTCAACTCCATGTCA | e-e-e-d$_{(10)}$-k-k-k | 56 | 1005 |
| 2513 | 2528 | 528810 | GAGGTCAACTCCATGT | e-e-e-d$_{(10)}$-k-k-k | 41 | 1006 |
| 2514 | 2529 | 528811 | CGAGGTCAACTCCATG | e-e-e-d$_{(10)}$-k-k-k | 45 | 1007 |
| 2515 | 2530 | 528812 | CCGAGGTCAACTCCAT | e-e-e-d$_{(10)}$-k-k-k | 45 | 1008 |
| 2517 | 2532 | 528813 | CTCCGAGGTCAACTCC | e-e-e-d$_{(10)}$-k-k-k | 58 | 1009 |
| 2518 | 2533 | 528814 | ACTCCGAGGTCAACTC | e-e-e-d$_{(10)}$-k-k-k | 40 | 1010 |
| 2519 | 2534 | 528815 | CACTCCGAGGTCAACT | e-e-e-d$_{(10)}$-k-k-k | 30 | 1011 |
| 2551 | 2566 | 528816 | CGTTCTCAGCTCCTCA | e-e-e-d$_{(10)}$-k-k-k | 54 | 1012 |

TABLE 11-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 2554 | 2569 | 528817 | TTCCGTTCTCAGCTCC | e-e-e-d$_{(10)}$-k-k-k | 53 | 1013 |
| 2555 | 2570 | 528818 | CTTCCGTTCTCAGCTC | e-e-e-d$_{(10)}$-k-k-k | 27 | 1014 |
| 2556 | 2571 | 528819 | GCTTCCGTTCTCAGCT | e-e-e-d$_{(10)}$-k-k-k | 35 | 1015 |
| 2557 | 2572 | 528820 | AGCTTCCGTTCTCAGC | e-e-e-d$_{(10)}$-k-k-k | 38 | 1016 |
| 2558 | 2573 | 528821 | CAGCTTCCGTTCTCAG | e-e-e-d$_{(10)}$-k-k-k | 53 | 1017 |
| 2559 | 2574 | 528822 | GCAGCTTCCGTTCTCA | e-e-e-d$_{(10)}$-k-k-k | 66 | 1018 |
| 2614 | 2629 | 528823 | TTTGGCTGTGTGAGGG | e-e-e-d$_{(10)}$-k-k-k | 62 | 1019 |
| 2615 | 2630 | 528824 | GTTTGGCTGTGTGAGG | e-e-e-d$_{(10)}$-k-k-k | 50 | 1020 |
| 2616 | 2631 | 528825 | GGTTTGGCTGTGTGAG | e-e-e-d$_{(10)}$-k-k-k | 15 | 1021 |
| 2641 | 2656 | 528826 | AAGTTAGTAGTTTCAG | e-e-e-d$_{(10)}$-k-k-k | 20 | 1022 |
| 2677 | 2692 | 528827 | GCAGAAGTAGGAGATT | e-e-e-d$_{(10)}$-k-k-k | 28 | 1023 |
| 2690 | 2705 | 528828 | TTGCTCAAAGATAGCA | e-e-e-d$_{(10)}$-k-k-k | 39 | 1024 |
| 2691 | 2706 | 528829 | ATTGCTCAAAGATAGC | e-e-e-d$_{(10)}$-k-k-k | 37 | 1025 |
| 2692 | 2707 | 528830 | GATTGCTCAAAGATAG | e-e-e-d$_{(10)}$-k-k-k | 22 | 1026 |
| 2694 | 2709 | 528831 | CAGATTGCTCAAAGAT | e-e-e-d$_{(10)}$-k-k-k | 26 | 1027 |
| 2695 | 2710 | 528832 | CCAGATTGCTCAAAGA | e-e-e-d$_{(10)}$-k-k-k | 41 | 1028 |
| 2699 | 2714 | 528833 | GTGCCCAGATTGCTCA | e-e-e-d$_{(10)}$-k-k-k | 77 | 1029 |
| 2738 | 2753 | 528834 | GCAGATCACCCACATT | e-e-e-d$_{(10)}$-k-k-k | 49 | 1030 |
| 2743 | 2758 | 528835 | TAAAAGCAGATCACCC | e-e-e-d$_{(10)}$-k-k-k | 40 | 1031 |
| 2809 | 2824 | 528836 | CTAGCCACCCCCCGCC | e-e-e-d$_{(10)}$-k-k-k | 19 | 1032 |
| 2810 | 2825 | 528837 | TCTAGCCACCCCCCGC | e-e-e-d$_{(10)}$-k-k-k | 9 | 1033 |
| 2811 | 2826 | 528838 | CTCTAGCCACCCCCCG | e-e-e-d$_{(10)}$-k-k-k | 16 | 1034 |
| 2908 | 2923 | 528839 | GGAGGCACTTGTCTAA | e-e-e-d$_{(10)}$-k-k-k | 56 | 235 |
| 2909 | 2924 | 528840 | AGGAGGCACTTGTCTA | e-e-e-d$_{(10)}$-k-k-k | 62 | 1036 |
| 2910 | 2925 | 528841 | CAGGAGGCACTTGTCT | e-e-e-d$_{(10)}$-k-k-k | 52 | 1037 |
| 2911 | 2926 | 528842 | CCAGGAGGCACTTGTC | e-e-e-d$_{(10)}$-k-k-k | 59 | 1038 |
| 2932 | 2947 | 528843 | GGCAGAAGGATGCCGC | e-e-e-d$_{(10)}$-k-k-k | 35 | 1039 |
| 2945 | 2960 | 528844 | GCTTACAGAAACAGGC | e-e-e-d$_{(10)}$-k-k-k | 62 | 1040 |
| 2980 | 2995 | 528845 | CAGGAGTATGTAGCTA | e-e-e-d$_{(10)}$-k-k-k | 65 | 1041 |
| 2981 | 2996 | 528846 | CCAGGAGTATGTAGCT | e-e-e-d$_{(10)}$-k-k-k | 80 | 1042 |
| 2982 | 2997 | 528847 | GCCAGGAGTATGTAGC | e-e-e-d$_{(10)}$-k-k-k | 72 | 1043 |
| 2983 | 2998 | 528848 | TGCCAGGAGTATGTAG | e-e-e-d$_{(10)}$-k-k-k | 46 | 1044 |
| 2984 | 2999 | 528849 | ATGCCAGGAGTATGTA | e-e-e-d$_{(10)}$-k-k-k | 59 | 241 |
| 3001 | 3016 | 528850 | CAAGGTTAAAAAGTGC | e-e-e-d$_{(10)}$-k-k-k | 10 | 243 |
| 3008 | 3023 | 528851 | ATGTCAGCAAGGTTAA | e-e-e-d$_{(10)}$-k-k-k | 61 | 1045 |
| 3010 | 3025 | 528852 | GGATGTCAGCAAGGTT | e-e-e-d$_{(10)}$-k-k-k | 88 | 1046 |

TABLE 11-continued

Inhibition of human STAT3 mRNA levels by chimeric antisense oligonuclotides targeted to SEQ ID NO: 1

| Human Start Site | Human Stop Site | ISIS No | Sequence | Chemistry | % inhibition | SEQ ID NO |
|---|---|---|---|---|---|---|
| 3012 | 3027 | 528853 | TTGGATGTCAGCAAGG | e-e-e-d$_{(10)}$-k-k-k | 91 | 1047 |
| 3016 | 3031 | 518349 | CTATTTGGATGTCAGC | e-e-e-d$_{(10)}$-k-k-k | 85 | 245 |
| 3030 | 3045 | 528854 | GATAGTCCTATCTTCT | e-e-e-d$_{(10)}$-k-k-k | 42 | 1048 |
| 3091 | 3106 | 528855 | ACAGTGTTTTTTGCCC | e-e-e-d$_{(10)}$-k-k-k | 59 | 1049 |
| 3108 | 3123 | 528856 | AGAAAGGCTATGCTGA | e-e-e-d$_{(10)}$-k-k-k | 56 | 1050 |
| 3452 | 3467 | 528857 | GAGGCTGTTAACTGAA | e-e-e-d$_{(10)}$-k-k-k | 40 | 1051 |
| 3458 | 3473 | 528858 | ACCAAGGAGGCTGTTA | e-e-e-d$_{(10)}$-k-k-k | 26 | 1052 |
| 3474 | 3489 | 528859 | GCTGAATGCTTAAAGC | e-e-e-d$_{(10)}$-k-k-k | 36 | 1053 |
| 4022 | 4037 | 518344 | GCCACTGGATATCACC | e-e-e-d$_{(10)}$-k-k-k | 55 | 317 |

Example 12

Dose-Dependent Antisense Inhibition of Human STAT3 in HuVEC Cells

Gapmers from the study described in Example 11, above, exhibiting significant in vitro inhibition of STAT3 were tested at various doses in HuVEC cells. Cells were plated at a density of 20,000 cells per well and transfected using electroporation with 23.4375 nM, 93.75 nM, 375.0 nM, and 1,500.0 nM concentrations of antisense oligonucleotide, as specified in Table 12. After a treatment period of approximately 16 hours, RNA was isolated from the cells and STAT3 mRNA levels were measured by quantitative real-time PCR. Human STAT3 primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration (IC$_{50}$) of each oligonucleotide is also presented in Table 12 and was calculated by plotting the concentrations of oligonucleotides used versus the percent inhibition of STAT3 mRNA expression achieved at each concentration, and noting the concentration of oligonucleotide at which 50% inhibition of STAT3 mRNA expression was achieved compared to the control. As illustrated in Table 12, STAT3 mRNA levels were significantly reduced in a dose-dependent manner in antisense oligonucleotide treated cells.

TABLE 12

Dose-dependent antisense inhibition of human STAT3 in HuVEC cells

| ISIS No | 23.4375 nM | 93.75 nM | 375.0 nM | 1500.0 nM | IC$_{50}$ (μM) |
|---|---|---|---|---|---|
| 518340 | 0 | 8 | 28 | 63 | 1.0 |
| 518349 | 13 | 30 | 68 | 90 | 0.2 |
| 528189 | 8 | 13 | 43 | 71 | 0.5 |
| 528204 | 4 | 24 | 53 | 79 | 0.3 |
| 528205 | 0 | 9 | 59 | 80 | 0.4 |
| 528208 | 0 | 19 | 56 | 84 | 0.3 |
| 528209 | 0 | 28 | 58 | 90 | 0.3 |
| 528210 | 0 | 16 | 49 | 87 | 0.3 |
| 528211 | 0 | 10 | 47 | 86 | 0.4 |
| 528212 | 0 | 16 | 42 | 83 | 0.4 |
| 528214 | 0 | 25 | 55 | 88 | 0.3 |
| 528215 | 3 | 16 | 53 | 82 | 0.3 |
| 528237 | 13 | 19 | 33 | 73 | 0.6 |
| 528245 | 3 | 16 | 53 | 78 | 0.4 |
| 528263 | 0 | 3 | 32 | 76 | 0.6 |
| 528264 | 9 | 0 | 19 | 50 | >1.5 |
| 528268 | 0 | 7 | 25 | 63 | 1.0 |
| 528269 | 0 | 11 | 39 | 77 | 0.5 |
| 528270 | 5 | 9 | 48 | 79 | 0.4 |
| 528271 | 0 | 14 | 37 | 81 | 0.5 |
| 528327 | 0 | 0 | 26 | 72 | 0.8 |
| 528347 | 0 | 2 | 25 | 69 | 0.9 |
| 528357 | 0 | 17 | 36 | 69 | 0.6 |
| 528389 | 0 | 3 | 19 | 82 | 0.7 |
| 528501 | 0 | 17 | 40 | 69 | 0.6 |
| 528502 | 0 | 10 | 35 | 76 | 0.6 |
| 528503 | 3 | 1 | 38 | 70 | 0.7 |
| 528504 | 0 | 19 | 45 | 72 | 0.5 |
| 528505 | 0 | 7 | 41 | 73 | 0.6 |
| 528518 | 0 | 24 | 51 | 81 | 0.3 |
| 528534 | 0 | 8 | 32 | 72 | 0.7 |
| 528539 | 0 | 7 | 39 | 73 | 0.6 |
| 528557 | 0 | 9 | 26 | 53 | >1.5 |
| 528565 | 4 | 12 | 31 | 57 | 1.3 |
| 528567 | 8 | 13 | 25 | 54 | >1.5 |
| 528569 | 9 | 19 | 37 | 60 | 0.8 |
| 528574 | 5 | 17 | 32 | 62 | 0.9 |
| 528622 | 10 | 4 | 29 | 68 | 0.9 |
| 528623 | 0 | 13 | 24 | 62 | 1.1 |
| 528626 | 1 | 0 | 34 | 68 | 0.8 |
| 528627 | 22 | 19 | 30 | 64 | 1.0 |
| 528664 | 0 | 14 | 37 | 74 | 0.5 |
| 528675 | 0 | 10 | 28 | 62 | 1.0 |
| 528689 | 0 | 16 | 33 | 65 | 0.7 |
| 528691 | 0 | 3 | 34 | 61 | 0.9 |
| 528695 | 1 | 4 | 36 | 66 | 0.8 |
| 528697 | 3 | 15 | 39 | 72 | 0.5 |
| 528710 | 13 | 16 | 28 | 63 | 1.0 |
| 528711 | 8 | 13 | 14 | 62 | >1.5 |
| 528726 | 0 | 8 | 36 | 72 | 0.6 |
| 528757 | 4 | 10 | 29 | 76 | 0.6 |

TABLE 12-continued

Dose-dependent antisense inhibition of human STAT3 in HuVEC cells

| ISIS No | 23.4375 nM | 93.75 nM | 375.0 nM | 1500.0 nM | IC$_{50}$ (µM) |
|---|---|---|---|---|---|
| 528758 | 1 | 5 | 28 | 62 | 1.1 |
| 528772 | 0 | 2 | 21 | 63 | 1.2 |
| 528773 | 9 | 8 | 28 | 70 | 0.8 |
| 528791 | 4 | 9 | 41 | 69 | 0.6 |
| 528822 | 0 | 0 | 40 | 46 | >1.5 |
| 528833 | 0 | 23 | 47 | 82 | 0.4 |
| 528846 | 10 | 19 | 49 | 85 | 0.3 |
| 528847 | 0 | 19 | 45 | 75 | 0.4 |
| 528852 | 5 | 33 | 66 | 93 | 0.2 |
| 528853 | 19 | 46 | 77 | 95 | 0.1 |

Example 13

Antisense Inhibition of Human STAT3 in HuVEC Cells

Antisense oligonucleotides were designed targeting a human STAT3 nucleic acid and were tested for their effect on human STAT3 mRNA expression in vitro. The chimeric antisense oligonucleotides in Tables 13 and 14 are gapmers 16 or 17 nucleotides in length having various chemical modifications. Each gapmer comprises a central gap segment consisting of nine or ten 2'-deoxynucleosides and is flanked on both sides (in the 5' and 3' directions) by wings comprising 1, 2, 3, 4, or 5 nucleotides each. Each of the nucleotides in the wings comprise a 2'-MOE sugar modification or a cEt sugar modification. Gapmer motifs include 3-10-3, 4-9-3, 2-10-4, 1-10-5, and 3-10-4. The chemistry column of Tables 13 and 14 provides the sugar motif of each gapmer, wherein 'e' indicates a 2'-MOE nucleoside, 'k' indicates a constrained ethyl (cEt) nucleoside, and indicates a 2'-deoxynucleoside. The internucleoside linkages throughout each gapmer are phosphorothioate (P=S) linkages. All cytosine residues throughout each gapmer are 5'-methylcytosines.

Potency of the chimeric antisense oligonucleotides was compared to ISIS 481464, ISIS 518344, and ISIS 518349 (described previously herein).

Cultured HuVEC cells at a density of 20,000 cells per well were transfected using electroporation with 1,000 nM antisense oligonucleotide. After a treatment period of approximately 24 hours, RNA was isolated from the cells and STAT3 mRNA levels were measured by quantitative real-time PCR. Human primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

"Human Target start site" indicates the 5'-most nucleoside to which the gapmer is targeted in the human gene sequence. "Human Target stop site" indicates the 3'-most nucleoside to which the gapmer is targeted in the human gene sequence. Each gapmer listed in Table 13 is targeted to human STAT3 mRNA, designated herein as SEQ ID NO: 1 (GENBANK Accession No. NM_139276.2). Each gapmer listed in Table 14 is targeted to human STAT3 genomic sequence, designated herein as SEQ ID NO: 2 (the complement of GENBANK Accession No. NT_010755.14 truncated from nucleotides 4185000 to 4264000).

TABLE 13

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 728 | 743 | 530423 | AGATTCTCTACCACTT | k-d(10)-k-e-k-e-e | 70 | 1054 |
| 729 | 745 | 530053 | GGAGATTCTCTACCACT | e-e-k-d(10)-k-e-k-e | 84 | 1055 |
| 729 | 744 | 530373 | GAGATTCTCTACCACT | e-k-d(10)-k-e-k-e | 85 | 1056 |
| 730 | 745 | 530121 | GGAGATTCTCTACCAC | e-k-k-d(10)-k-k-e | 77 | 53 |
| 730 | 745 | 530168 | GGAGATTCTCTACCAC | e-e-k-d(10)-k-k-e | 75 | 53 |
| 730 | 745 | 530218 | GGAGATTCTCTACCAC | e-d-k-d(10)-k-k-e | 61 | 53 |
| 730 | 745 | 530268 | GGAGATTCTCTACCAC | e-d-d-k-d(9)-k-k-e | 76 | 53 |
| 730 | 745 | 530318 | GGAGATTCTCTACCAC | e-e-e-e-d(9)-k-k-e | 27 | 53 |
| 786 | 801 | 530424 | ATCTTGCATGTCTCCT | k-d(10)-k-e-k-e-e | 42 | 1057 |
| 787 | 803 | 530058 | AGATCTTGCATGTCTCC | e-e-k-d(10)-k-e-k-e | 73 | 1058 |
| 787 | 802 | 530374 | GATCTTGCATGTCTCC | e-k-d(10)-k-e-k-e | 71 | 647 |
| 788 | 803 | 530122 | AGATCTTGCATGTCTC | e-k-k-d(10)-k-k-e | 80 | 57 |
| 788 | 803 | 530169 | AGATCTTGCATGTCTC | e-e-k-d(10)-k-k-e | 72 | 57 |
| 788 | 803 | 530219 | AGATCTTGCATGTCTC | e-d-k-d(10)-k-k-e | 55 | 57 |
| 788 | 803 | 530269 | AGATCTTGCATGTCTC | e-d-d-k-d(9)-k-k-e | 76 | 57 |
| 788 | 803 | 530319 | AGATCTTGCATGTCTC | e-e-e-e-d(9)-k-k-e | 30 | 57 |

TABLE 13-continued

Inhibition of human STAT3 mRNA levels by chimeric antisense
oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 892 | 907 | 528400 | CCGCCAGCTCACTCAC | e-e-e-d(10)-k-k-k | 57 | 66 |
| 893 | 908 | 528401 | CCCGCCAGCTCACTCA | e-e-e-d(10)-k-k-k | 57 | 1059 |
| 894 | 909 | 528402 | CCCCGCCAGCTCACTC | e-e-e-d(10)-k-k-k | 42 | 1060 |
| 897 | 912 | 528403 | AAGCCCCGCCAGCTCA | e-e-e-d(10)-k-k-k | 72 | 1061 |
| 898 | 913 | 528404 | AAAGCCCCGCCAGCTC | e-e-e-d(10)-k-k-k | 52 | 1062 |
| 899 | 914 | 528405 | AAAAGCCCCGCCAGCT | e-e-e-d(10)-k-k-k | 27 | 1063 |
| 900 | 915 | 528406 | CAAAAGCCCCGCCAGC | e-e-e-d(10)-k-k-k | 29 | 1064 |
| 901 | 916 | 528407 | ACAAAAGCCCCGCCAG | e-e-e-d(10)-k-k-k | 9 | 1065 |
| 903 | 918 | 528408 | TGACAAAAGCCCCGCC | e-e-e-d(10)-k-k-k | 10 | 1066 |
| 904 | 919 | 528409 | CTGACAAAAGCCCCGC | e-e-e-d(10)-k-k-k | 31 | 1067 |
| 905 | 920 | 528410 | GCTGACAAAAGCCCCG | e-e-e-d(10)-k-k-k | 39 | 1068 |
| 906 | 921 | 528411 | CGCTGACAAAAGCCCC | e-e-e-d(10)-k-k-k | 49 | 1069 |
| 907 | 922 | 528412 | TCGCTGACAAAAGCCC | e-e-e-d(10)-k-k-k | 39 | 1070 |
| 908 | 923 | 528413 | ATCGCTGACAAAAGCC | e-e-e-d(10)-k-k-k | 20 | 1071 |
| 909 | 924 | 528414 | CATCGCTGACAAAAGC | e-e-e-d(10)-k-k-k | 10 | 1072 |
| 911 | 926 | 528415 | TCCATCGCTGACAAAA | e-e-e-d(10)-k-k-k | 11 | 1073 |
| 912 | 927 | 528416 | CTCCATCGCTGACAAA | e-e-e-d(10)-k-k-k | 15 | 1074 |
| 913 | 928 | 528417 | ACTCCATCGCTGACAA | e-e-e-d(10)-k-k-k | 22 | 1075 |
| 914 | 929 | 528418 | TACTCCATCGCTGACA | e-e-e-d(10)-k-k-k | 19 | 1076 |
| 915 | 930 | 528419 | GTACTCCATCGCTGAC | e-e-e-d(10)-k-k-k | 37 | 1077 |
| 916 | 931 | 528420 | CGTACTCCATCGCTGA | e-e-e-d(10)-k-k-k | 35 | 1078 |
| 930 | 945 | 528421 | GAGAGTTTTCTGCACG | e-e-e-d(10)-k-k-k | 36 | 1079 |
| 932 | 947 | 528422 | GTGAGAGTTTTCTGCA | e-e-e-d(10)-k-k-k | 22 | 1080 |
| 951 | 966 | 528423 | GTCAGCCAGCTCCTCG | e-e-e-d(10)-k-k-k | 49 | 1081 |
| 962 | 977 | 528424 | CGCCTCTTCCAGTCAG | e-e-e-d(10)-k-k-k | 42 | 1082 |
| 964 | 979 | 528425 | GCCGCCTCTTCCAGTC | e-e-e-d(10)-k-k-k | 44 | 1083 |
| 965 | 980 | 528426 | TGCCGCCTCTTCCAGT | e-e-e-d(10)-k-k-k | 15 | 1084 |
| 970 | 985 | 528427 | TCTGTTGCCGCCTCTT | e-e-e-d(10)-k-k-k | 9 | 1085 |
| 971 | 986 | 528428 | ATCTGTTGCCGCCTCT | e-e-e-d(10)-k-k-k | 30 | 1086 |
| 972 | 987 | 528429 | AATCTGTTGCCGCCTC | e-e-e-d(10)-k-k-k | 23 | 1087 |
| 973 | 988 | 528430 | CAATCTGTTGCCGCCT | e-e-e-d(10)-k-k-k | 12 | 1088 |
| 974 | 989 | 528431 | GCAATCTGTTGCCGCC | e-e-e-d(10)-k-k-k | 48 | 1089 |
| 975 | 990 | 528432 | GGCAATCTGTTGCCGC | e-e-e-d(10)-k-k-k | 18 | 1090 |
| 976 | 991 | 528433 | AGGCAATCTGTTGCCG | e-e-e-d(10)-k-k-k | 0 | 1091 |
| 977 | 992 | 528434 | CAGGCAATCTGTTGCC | e-e-e-d(10)-k-k-k | 8 | 1092 |
| 978 | 993 | 528435 | GCAGGCAATCTGTTGC | e-e-e-d(10)-k-k-k | 13 | 1093 |
| 982 | 997 | 528436 | CAATGCAGGCAATCTG | e-e-e-d(10)-k-k-k | 9 | 1094 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 983 | 998 | 528437 | CCAATGCAGGCAATCT | e-e-e-d(10)-k-k-k | 26 | 1095 |
| 984 | 999 | 528438 | TCCAATGCAGGCAATC | e-e-e-d(10)-k-k-k | 10 | 1096 |
| 985 | 1000 | 528439 | CTCCAATGCAGGCAAT | e-e-e-d(10)-k-k-k | 2 | 1097 |
| 986 | 1001 | 528440 | CCTCCAATGCAGGCAA | e-e-e-d(10)-k-k-k | 28 | 1098 |
| 1003 | 1018 | 528441 | GGCAGATGTTGGGCGG | e-e-e-d(10)-k-k-k | 8 | 1099 |
| 1004 | 1019 | 528442 | AGGCAGATGTTGGGCG | e-e-e-d(10)-k-k-k | 0 | 1100 |
| 1005 | 1020 | 528443 | TAGGCAGATGTTGGGC | e-e-e-d(10)-k-k-k | 1 | 1101 |
| 1006 | 1021 | 528444 | CTAGGCAGATGTTGGG | e-e-e-d(10)-k-k-k | 0 | 1102 |
| 1007 | 1022 | 528445 | TCTAGGCAGATGTTGG | e-e-e-d(10)-k-k-k | 7 | 1103 |
| 1008 | 1023 | 528446 | ATCTAGGCAGATGTTG | e-e-e-d(10)-k-k-k | 3 | 1104 |
| 1010 | 1025 | 528447 | CGATCTAGGCAGATGT | e-e-e-d(10)-k-k-k | 9 | 72 |
| 1011 | 1026 | 528448 | CCGATCTAGGCAGATG | e-e-e-d(10)-k-k-k | 13 | 1105 |
| 1013 | 1028 | 528449 | AGCCGATCTAGGCAGA | e-e-e-d(10)-k-k-k | 4 | 1106 |
| 1014 | 1029 | 528450 | TAGCCGATCTAGGCAG | e-e-e-d(10)-k-k-k | 11 | 1107 |
| 1015 | 1030 | 528451 | CTAGCCGATCTAGGCA | e-e-e-d(10)-k-k-k | 5 | 1108 |
| 1016 | 1031 | 528452 | TCTAGCCGATCTAGGC | e-e-e-d(10)-k-k-k | 5 | 1109 |
| 1017 | 1032 | 528453 | TTCTAGCCGATCTAGG | e-e-e-d(10)-k-k-k | 24 | 1110 |
| 1018 | 1033 | 528454 | TTTCTAGCCGATCTAG | e-e-e-d(10)-k-k-k | 29 | 1111 |
| 1019 | 1034 | 528455 | TTTTCTAGCCGATCTA | e-e-e-d(10)-k-k-k | 28 | 1112 |
| 1020 | 1035 | 528456 | GTTTTCTAGCCGATCT | e-e-e-d(10)-k-k-k | 42 | 1113 |
| 1022 | 1037 | 528457 | CAGTTTTCTAGCCGAT | e-e-e-d(10)-k-k-k | 50 | 1114 |
| 1023 | 1038 | 528458 | CCAGTTTTCTAGCCGA | e-e-e-d(10)-k-k-k | 70 | 1115 |
| 1024 | 1039 | 528459 | TCCAGTTTTCTAGCCG | e-e-e-d(10)-k-k-k | 56 | 1116 |
| 1025 | 1040 | 528460 | ATCCAGTTTTCTAGCC | e-e-e-d(10)-k-k-k | 42 | 1117 |
| 1029 | 1044 | 528461 | CGTTATCCAGTTTTCT | e-e-e-d(10)-k-k-k | 47 | 1118 |
| 1043 | 1058 | 528462 | GATTCTGCTAATGACG | e-e-e-d(10)-k-k-k | 42 | 1119 |
| 1044 | 1059 | 528463 | AGATTCTGCTAATGAC | e-e-e-d(10)-k-k-k | 38 | 1120 |
| 1048 | 1063 | 528464 | GTTGAGATTCTGCTAA | e-e-e-d(10)-k-k-k | 30 | 1121 |
| 1049 | 1064 | 528465 | AGTTGAGATTCTGCTA | e-e-e-d(10)-k-k-k | 48 | 1122 |
| 1056 | 1071 | 528466 | GGTCTGAAGTTGAGAT | e-e-e-d(10)-k-k-k | 27 | 1123 |
| 1058 | 1073 | 528467 | CGGGTCTGAAGTTGAG | e-e-e-d(10)-k-k-k | 44 | 1124 |
| 1059 | 1074 | 528468 | ACGGGTCTGAAGTTGA | e-e-e-d(10)-k-k-k | 41 | 1125 |
| 1060 | 1075 | 528469 | GACGGGTCTGAAGTTG | e-e-e-d(10)-k-k-k | 45 | 1126 |
| 1061 | 1076 | 528470 | TGACGGGTCTGAAGTT | e-e-e-d(10)-k-k-k | 34 | 1127 |
| 1062 | 1077 | 528471 | TTGACGGGTCTGAAGT | e-e-e-d(10)-k-k-k | 19 | 1128 |
| 1063 | 1078 | 528472 | GTTGACGGGTCTGAAG | e-e-e-d(10)-k-k-k | 21 | 1129 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 1064 | 1079 | 528473 | TGTTGACGGGTCTGAA | e-e-e-d(10)-k-k-k | 37 | 1130 |
| 1065 | 1080 | 528474 | TTGTTGACGGGTCTGA | e-e-e-d(10)-k-k-k | 55 | 1131 |
| 1066 | 1081 | 528475 | TTTGTTGACGGGTCTG | e-e-e-d(10)-k-k-k | 63 | 1132 |
| 1067 | 1082 | 528476 | ATTTGTTGACGGGTCT | e-e-e-d(10)-k-k-k | 65 | 1133 |
| 1899 | 1914 | 530425 | GCCCTTGCCAGCCATG | k-d(10)-k-e-k-e-e | 73 | 1134 |
| 1900 | 1916 | 530054 | AAGCCCTTGCCAGCCAT | e-e-k-d(10)-k-e-k-e | 75 | 1135 |
| 1900 | 1915 | 530375 | AGCCCTTGCCAGCCAT | e-k-d(10)-k-e-k-e | 77 | 1136 |
| 1901 | 1916 | 530123 | AAGCCCTTGCCAGCCA | e-k-k-d(10)-k-k-e | 86 | 144 |
| 1901 | 1916 | 530170 | AGCCCTTGCCAGCCA | e-e-k-d(10)-k-k-e | 87 | 144 |
| 1901 | 1916 | 530220 | AAGCCCTTGCCAGCCA | e-d-k-d(10)-k-k-e | 74 | 144 |
| 1901 | 1916 | 530270 | AGCCCTTGCCAGCCA | e-d-d-k-d(9)-k-k-e | 87 | 144 |
| 1901 | 1916 | 530320 | AAGCCCTTGCCAGCCA | e-e-e-e-d(9)-k-k-e | 17 | 144 |
| 1946 | 1961 | 530426 | TTTTTCACAAGGTCAA | k-d(10)-k-e-k-e-e | 55 | 1137 |
| 1947 | 1963 | 530059 | ACTTTTTCACAAGGTCA | e-e-k-d(10)-k-e-k-e | 73 | 1138 |
| 1947 | 1962 | 530376 | CTTTTTCACAAGGTCA | e-k-d(10)-k-e-k-e | 77 | 1139 |
| 1948 | 1963 | 530124 | ACTTTTTCACAAGGTC | e-k-k-d(10)-k-k-e | 79 | 153 |
| 1948 | 1963 | 530171 | ACTTTTTCACAAGGTC | e-e-k-d(10)-k-k-e | 69 | 153 |
| 1948 | 1963 | 530221 | ACTTTTTCACAAGGTC | e-d-k-d(10)-k-k-e | 64 | 153 |
| 1948 | 1963 | 530271 | ACTTTTTCACAAGGTC | e-d-d-k-d(9)-k-k-e | 73 | 153 |
| 1948 | 1963 | 530321 | ACTTTTTCACAAGGTC | e-e-e-e-d(9)-k-k-e | 44 | 153 |
| 2204 | 2219 | 530427 | ATGATCTTATAGCCCA | k-d(10)-k-e-k-e-e | 43 | 931 |
| 2205 | 2221 | 530060 | CCATGATCTTATAGCCC | e-e-k-d(10)-k-e-k-e | 77 | 1140 |
| 2205 | 2220 | 530377 | CATGATCTTATAGCCC | e-k-d(10)-k-e-k-e | 66 | 932 |
| 2206 | 2221 | 530125 | CCATGATCTTATAGCC | e-k-k-d(10)-k-k-e | 65 | 175 |
| 2206 | 2221 | 530172 | CCATGATCTTATAGCC | e-e-k-d(10)-k-k-e | 59 | 175 |
| 2206 | 2221 | 530222 | CCATGATCTTATAGCC | e-d-k-d(10)-k-k-e | 48 | 175 |
| 2206 | 2221 | 530272 | CCATGATCTTATAGCC | e-d-d-k-d(9)-k-k-e | 63 | 175 |
| 2206 | 2221 | 530322 | CCATGATCTTATAGCC | e-e-e-e-d(9)-k-k-e | 55 | 175 |
| 2679 | 2694 | 530428 | TAGCAGAAGTAGGAGA | k-d(10)-k-e-k-e-e | 49 | 1141 |
| 2680 | 2696 | 530061 | GATAGCAGAAGTAGGAG | e-e-k-d(10)-k-e-k-e | 49 | 1142 |
| 2680 | 2695 | 530378 | ATAGCAGAAGTAGGAG | e-k-d(10)-k-e-k-e | 48 | 1143 |
| 2681 | 2696 | 530126 | GATAGCAGAAGTAGGA | e-k-k-d(10)-k-k-e | 70 | 223 |
| 2681 | 2696 | 530173 | GATAGCAGAAGTAGGA | e-e-k-d(10)-k-k-e | 62 | 223 |
| 2681 | 2696 | 530223 | GATAGCAGAAGTAGGA | e-d-k-d(10)-k-k-e | 44 | 223 |
| 2681 | 2696 | 530273 | GATAGCAGAAGTAGGA | e-d-d-k-d(9)-k-k-e | 63 | 223 |
| 2681 | 2696 | 530323 | GATAGCAGAAGTAGGA | e-e-e-e-d(9)-k-k-e | 63 | 223 |
| 3012 | 3027 | 530513 | TTGGATGTCAGCAAGG | k-d(10)-k-e-k-e-e | 88 | 1047 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 3013 | 3028 | 530507 | TTTGGATGTCAGCAAG | e-k-d(10)-k-e-k-e | 86 | 1144 |
| 3013 | 3028 | 530514 | TTTGGATGTCAGCAAG | k-d(10)-k-e-k-e-e | 80 | 1144 |
| 3014 | 3029 | 530430 | ATTTGGATGTCAGCAA | k-d(10)-k-e-k-e-e | 87 | 1145 |
| 3014 | 3029 | 530468 | ATTTGGATGTCAGCAA | e-k-k-d(10)-k-k-e | 81 | 1145 |
| 3014 | 3029 | 530476 | ATTTGGATGTCAGCAA | e-e-k-d(10)-k-k-e | 82 | 1145 |
| 3014 | 3029 | 530484 | ATTTGGATGTCAGCAA | e-d-k-d(10)-k-k-e | 74 | 1145 |
| 3014 | 3029 | 530492 | ATTTGGATGTCAGCAA | e-d-d-k-d(9)-k-k-e | 83 | 1145 |
| 3014 | 3029 | 530500 | ATTTGGATGTCAGCAA | e-e-e-e-d(9)-k-k-e | 56 | 1145 |
| 3014 | 3029 | 530508 | ATTTGGATGTCAGCAA | e-k-d(10)-k-e-k-e | 83 | 1145 |
| 3015 | 3031 | 530062 | CTATTTGGATGTCAGCA | e-e-k-d(10)-k-e-k-e | 94 | 1146 |
| 3015 | 3030 | 530380 | TATTTGGATGTCAGCA | e-k-d(10)-k-e-k-e | 94 | 1147 |
| 3015 | 3030 | 530469 | TATTTGGATGTCAGCA | e-k-k-d(10)-k-k-e | 91 | 1147 |
| 3015 | 3030 | 530477 | TATTTGGATGTCAGCA | e-e-k-d(10)-k-k-e | 87 | 1147 |
| 3015 | 3030 | 530485 | TATTTGGATGTCAGCA | e-d-k-d(10)-k-k-e | 87 | 1147 |
| 3015 | 3030 | 530493 | TATTTGGATGTCAGCA | e-d-d-k-d(9)-k-k-e | 81 | 1147 |
| 3015 | 3030 | 530501 | TATTTGGATGTCAGCA | e-e-e-e-d(9)-k-k-e | 74 | 1147 |
| 3015 | 3030 | 530515 | TATTTGGATGTCAGCA | k-d(10)-k-e-k-e-e | 87 | 1147 |
| 3016 | 3031 | 481464 | CTATTTGGATGTCAGC | k-k-k-d(10)-k-k-k | 93 | 245 |
| 3016 | 3031 | 518349 | CTATTTGGATGTCAGC | e-e-e-d(10)-k-k-k | 58 | 245 |
| 3016 | 3031 | 519637 | CTATTTGGATGTCAGC | e-k-d(10)-k-k-k-e | 96 | 245 |
| 3016 | 3031 | 530175 | CTATTTGGATGTCAGC | e-e-k-d(10)-k-k-e | 93 | 245 |
| 3016 | 3031 | 530225 | CTATTTGGATGTCAGC | e-d-k-d(10)-k-k-e | 85 | 245 |
| 3016 | 3031 | 530275 | CTATTTGGATGTCAGC | e-d-d-k-d(9)-k-k-e | 91 | 245 |
| 3016 | 3031 | 530325 | CTATTTGGATGTCAGC | e-e-e-e-d(9)-k-k-e | 91 | 245 |
| 3017 | 3032 | 530470 | TCTATTTGGATGTCAG | e-k-k-d(10)-k-k-e | 91 | 1148 |
| 3017 | 3032 | 530478 | TCTATTTGGATGTCAG | e-e-k-d(10)-k-k-e | 87 | 1148 |
| 3017 | 3032 | 530486 | TCTATTTGGATGTCAG | e-d-k-d(10)-k-k-e | 84 | 1148 |
| 3017 | 3032 | 530494 | TCTATTTGGATGTCAG | e-d-d-k-d(9)-k-k-e | 60 | 1148 |
| 3017 | 3032 | 530502 | TCTATTTGGATGTCAG | e-e-e-e-d(9)-k-k-e | 64 | 1148 |
| 3017 | 3032 | 530509 | TCTATTTGGATGTCAG | e-k-d(10)-k-e-k-e | 80 | 1148 |
| 3018 | 3033 | 530471 | TTCTATTTGGATGTCA | e-k-k-d(10)-k-k-e | 83 | 1149 |
| 3018 | 3033 | 530479 | TTCTATTTGGATGTCA | e-e-k-d(10)-k-k-e | 74 | 1149 |
| 3018 | 3033 | 530487 | TTCTATTTGGATGTCA | e-d-k-d(10)-k-k-e | 71 | 1149 |
| 3018 | 3033 | 530495 | TTCTATTTGGATGTCA | e-d-d-k-d(9)-k-k-e | 68 | 1149 |
| 3018 | 3033 | 530503 | TTCTATTTGGATGTCA | e-e-e-e-d(9)-k-k-e | 53 | 1149 |
| 3459 | 3474 | 530431 | CACCAAGGAGGCTGTT | k-d(10)-k-e-k-e-e | 44 | 1150 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 3460 | 3476 | 530055 | AGCACCAAGGAGGCTGT | e-e-k-d(10)-k-e-k-e | 45 | 1151 |
| 3460 | 3475 | 530381 | GCACCAAGGAGGCTGT | e-k-d(10)-k-e-k-e | 74 | 1152 |
| 3461 | 3476 | 530128 | AGCACCAAGGAGGCTG | e-k-k-d(10)-k-k-e | 52 | 257 |
| 3461 | 3476 | 530176 | AGCACCAAGGAGGCTG | e-e-k-d(10)-k-k-e | 66 | 257 |
| 3461 | 3476 | 530226 | AGCACCAAGGAGGCTG | e-d-k-d(10)-k-k-e | 51 | 257 |
| 3461 | 3476 | 530276 | AGCACCAAGGAGGCTG | e-d-d-k-d(9)-k-k-e | 70 | 257 |
| 3461 | 3476 | 530326 | AGCACCAAGGAGGCTG | e-e-e-e-d(9)-k-k-e | 52 | 257 |
| 3527 | 3542 | 528860 | GGTTTGACCTGAAGCC | e-e-e-d(10)-k-k-k | 58 | 1153 |
| 3528 | 3543 | 528861 | GGGTTTGACCTGAAGC | e-e-e-d(10)-k-k-k | 42 | 1154 |
| 3529 | 3544 | 528862 | AGGGTTTGACCTGAAG | e-e-e-d(10)-k-k-k | 57 | 1155 |
| 3530 | 3545 | 528863 | AAGGGTTTGACCTGAA | e-e-e-d(10)-k-k-k | 43 | 1156 |
| 3531 | 3546 | 528864 | TAAGGGTTTGACCTGA | e-e-e-d(10)-k-k-k | 50 | 1157 |
| 3532 | 3547 | 528865 | TTAAGGGTTTGACCTG | e-e-e-d(10)-k-k-k | 32 | 1158 |
| 3547 | 3562 | 528866 | GCAGCTTCAGATGTCT | e-e-e-d(10)-k-k-k | 60 | 1159 |
| 3548 | 3563 | 528867 | TGCAGCTTCAGATGTC | e-e-e-d(10)-k-k-k | 47 | 1160 |
| 3583 | 3598 | 530388 | CTTAAACCTTCCTATT | k-d(10)-k-e-k-e-e | 14 | 1161 |
| 3584 | 3599 | 530338 | CCTTAAACCTTCCTAT | e-k-d(10)-k-e-k-e | 47 | 1162 |
| 3585 | 3600 | 530086 | TCCTTAAACCTTCCTA | e-k-k-d(10)-k-k-e | 58 | 273 |
| 3585 | 3600 | 530133 | TCCTTAAACCTTCCTA | e-e-k-d(10)-k-k-e | 53 | 273 |
| 3585 | 3600 | 530183 | TCCTTAAACCTTCCTA | e-d-k-d(10)-k-k-e | 52 | 273 |
| 3585 | 3600 | 530233 | TCCTTAAACCTTCCTA | e-d-d-k-d(9)-k-k-e | 29 | 273 |
| 3585 | 3600 | 530283 | TCCTTAAACCTTCCTA | e-e-e-e-d(9)-k-k-e | 32 | 273 |
| 3590 | 3605 | 528868 | GATTCTCCTTAAACCT | e-e-e-d(10)-k-k-k | 45 | 1163 |
| 3591 | 3606 | 530389 | AGATTCTCCTTAAACC | k-d(10)-k-e-k-e-e | 44 | 1164 |
| 3592 | 3607 | 530339 | TAGATTCTCCTTAAAC | e-k-d(10)-k-e-k-e | 41 | 1165 |
| 3593 | 3608 | 530087 | TTAGATTCTCCTTAAA | e-k-k-d(10)-k-k-e | 43 | 1166 |
| 3593 | 3608 | 530134 | TTAGATTCTCCTTAAA | e-e-k-d(10)-k-k-e | 28 | 1166 |
| 3593 | 3608 | 530184 | TTAGATTCTCCTTAAA | e-d-k-d(10)-k-k-e | 13 | 1166 |
| 3593 | 3608 | 530234 | TTAGATTCTCCTTAAA | e-d-d-k-d(9)-k-k-e | 15 | 1166 |
| 3593 | 3608 | 530284 | TTAGATTCTCCTTAAA | e-e-e-e-d(9)-k-k-e | 14 | 1166 |
| 3595 | 3610 | 530390 | GCTTAGATTCTCCTTA | k-d(10)-k-e-k-e-e | 83 | 1167 |
| 3596 | 3611 | 530340 | TGCTTAGATTCTCCTT | e-k-d(10)-k-e-k-e | 89 | 1168 |
| 3597 | 3612 | 528869 | ATGCTTAGATTCTCCT | e-e-e-d(10)-k-k-k | 83 | 1169 |
| 3597 | 3612 | 530088 | ATGCTTAGATTCTCCT | e-k-k-d(10)-k-k-e | 90 | 1169 |
| 3597 | 3612 | 530135 | ATGCTTAGATTCTCCT | e-e-k-d(10)-k-k-e | 91 | 1169 |
| 3597 | 3612 | 530185 | ATGCTTAGATTCTCCT | e-d-k-d(10)-k-k-e | 85 | 1169 |
| 3597 | 3612 | 530235 | ATGCTTAGATTCTCCT | e-d-d-k-d(9)-k-k-e | 28 | 1169 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 3597 | 3612 | 530285 | ATGCTTAGATTCTCCT | e-e-e-e-d(9)-k-k-e | 86 | 1169 |
| 3597 | 3612 | 530391 | ATGCTTAGATTCTCCT | k-d(10)-k-e-k-e-e | 79 | 1169 |
| 3598 | 3614 | 530021 | AAATGCTTAGATTCTCC | e-e-k-d(10)-k-e-k-e | 87 | 1170 |
| 3598 | 3613 | 530341 | AATGCTTAGATTCTCC | e-k-d(10)-k-e-k-e | 88 | 1171 |
| 3599 | 3614 | 530089 | AAATGCTTAGATTCTC | e-k-k-d(10)-k-k-e | 71 | 1172 |
| 3599 | 3614 | 530136 | AAATGCTTAGATTCTC | e-e-k-d(10)-k-k-e | 66 | 1172 |
| 3599 | 3614 | 530186 | AAATGCTTAGATTCTC | e-d-k-d(10)-k-k-e | 51 | 1172 |
| 3599 | 3614 | 530236 | AAATGCTTAGATTCTC | e-d-d-k-d(9)-k-k-e | 74 | 1172 |
| 3599 | 3614 | 530286 | AAATGCTTAGATTCTC | e-e-e-e-d(9)-k-k-e | 56 | 1172 |
| 3682 | 3697 | 528870 | GTAAGCACCCTCTGCC | e-e-e-d(10)-k-k-k | 26 | 1173 |
| 3684 | 3699 | 528871 | TTGTAAGCACCCTCTG | e-e-e-d(10)-k-k-k | 14 | 1174 |
| 3686 | 3701 | 528872 | GGTTGTAAGCACCCTC | e-e-e-d(10)-k-k-k | 47 | 1175 |
| 3687 | 3702 | 528873 | AGGTTGTAAGCACCCT | e-e-e-d(10)-k-k-k | 40 | 1176 |
| 3688 | 3703 | 528874 | AAGGTTGTAAGCACCC | e-e-e-d(10)-k-k-k | 54 | 1177 |
| 3690 | 3705 | 528875 | TCAAGGTTGTAAGCAC | e-e-e-d(10)-k-k-k | 15 | 1178 |
| 3691 | 3706 | 528876 | GTCAAGGTTGTAAGCA | e-e-e-d(10)-k-k-k | 28 | 1179 |
| 3692 | 3707 | 528877 | AGTCAAGGTTGTAAGC | e-e-e-d(10)-k-k-k | 28 | 1180 |
| 3694 | 3709 | 528878 | GGAGTCAAGGTTGTAA | e-e-e-d(10)-k-k-k | 6 | 1181 |
| 3695 | 3710 | 528879 | GGGAGTCAAGGTTGTA | e-e-e-d(10)-k-k-k | 22 | 1182 |
| 3714 | 3729 | 530392 | GATCAAGTCCAGGGAG | k-d(10)-k-e-k-e-e | 47 | 1183 |
| 3715 | 3731 | 530022 | CAGATCAAGTCCAGGGA | e-e-k-d(10)-k-e-k-e | 80 | 1184 |
| 3715 | 3730 | 530342 | AGATCAAGTCCAGGGA | e-k-d(10)-k-e-k-e | 70 | 1185 |
| 3715 | 3730 | 530393 | AGATCAAGTCCAGGGA | k-d(10)-k-e-k-e-e | 46 | 1185 |
| 3716 | 3732 | 530023 | GCAGATCAAGTCCAGGG | e-e-k-d(10)-k-e-k-e | 74 | 1186 |
| 3716 | 3731 | 530090 | CAGATCAAGTCCAGGG | e-k-k-d(10)-k-k-e | 78 | 1187 |
| 3716 | 3731 | 530137 | CAGATCAAGTCCAGGG | e-e-k-d(10)-k-k-e | 76 | 1187 |
| 3716 | 3731 | 530187 | CAGATCAAGTCCAGGG | e-d-k-d(10)-k-k-e | 68 | 1187 |
| 3716 | 3731 | 530237 | CAGATCAAGTCCAGGG | e-d-d-k-d(9)-k-k-e | 36 | 1187 |
| 3716 | 3731 | 530287 | CAGATCAAGTCCAGGG | e-e-e-e-d(9)-k-k-e | 56 | 1187 |
| 3716 | 3731 | 530343 | CAGATCAAGTCCAGGG | e-k-d(10)-k-e-k-e | 68 | 1187 |
| 3716 | 3731 | 530394 | CAGATCAAGTCCAGGG | k-d(10)-k-e-k-e-e | 49 | 1187 |
| 3717 | 3732 | 518343 | GCAGATCAAGTCCAGG | e-e-e-d(10)-k-k-k | 5 | 1188 |
| 3717 | 3733 | 530024 | AGCAGATCAAGTCCAGG | e-e-k-d(10)-k-e-k-e | 79 | 1189 |
| 3717 | 3732 | 530091 | GCAGATCAAGTCCAGG | e-k-k-d(10)-k-k-e | 81 | 1188 |
| 3717 | 3732 | 530138 | GCAGATCAAGTCCAGG | e-e-k-d(10)-k-k-e | 81 | 1188 |
| 3717 | 3732 | 530188 | GCAGATCAAGTCCAGG | e-d-k-d(10)-k-k-e | 78 | 1188 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 3717 | 3732 | 530238 | GCAGATCAAGTCCAGG | e-d-d-k-d(9)-k-k-e | 29 | 1188 |
| 3717 | 3732 | 530288 | GCAGATCAAGTCCAGG | e-e-e-e-d(9)-k-k-e | 69 | 1188 |
| 3717 | 3732 | 530344 | GCAGATCAAGTCCAGG | e-k-d(10)-k-e-k-e | 85 | 1188 |
| 3718 | 3733 | 530092 | AGCAGATCAAGTCCAG | e-k-k-d(10)-k-k-e | 85 | 1190 |
| 3718 | 3733 | 530139 | AGCAGATCAAGTCCAG | e-e-k-d(10)-k-k-e | 79 | 1190 |
| 3718 | 3733 | 530189 | AGCAGATCAAGTCCAG | e-d-k-d(10)-k-k-e | 77 | 1190 |
| 3718 | 3733 | 530239 | AGCAGATCAAGTCCAG | e-d-d-k-d(9)-k-k-e | 61 | 1190 |
| 3718 | 3733 | 530289 | AGCAGATCAAGTCCAG | e-e-e-e-d(9)-k-k-e | 75 | 1190 |
| 3720 | 3735 | 528880 | ACAGCAGATCAAGTCC | e-e-e-d(10)-k-k-k | 65 | 1191 |
| 3721 | 3736 | 528881 | AACAGCAGATCAAGTC | e-e-e-d(10)-k-k-k | 44 | 1192 |
| 3737 | 3752 | 528882 | ACAACCTAGCCTCTGA | e-e-e-d(10)-k-k-k | 39 | 1193 |
| 3738 | 3753 | 528883 | AACAACCTAGCCTCTG | e-e-e-d(10)-k-k-k | 46 | 1194 |
| 3740 | 3755 | 528884 | GAAACAACCTAGCCTC | e-e-e-d(10)-k-k-k | 37 | 1195 |
| 3741 | 3756 | 528885 | AGAAACAACCTAGCCT | e-e-e-d(10)-k-k-k | 20 | 1196 |
| 3742 | 3757 | 528886 | CAGAAACAACCTAGCC | e-e-e-d(10)-k-k-k | 21 | 1197 |
| 3755 | 3770 | 528887 | GATAAGGCACCCACAG | e-e-e-d(10)-k-k-k | 25 | 1198 |
| 3756 | 3771 | 528888 | TGATAAGGCACCCACA | e-e-e-d(10)-k-k-k | 12 | 1199 |
| 3757 | 3772 | 528889 | CTGATAAGGCACCCAC | e-e-e-d(10)-k-k-k | 25 | 1200 |
| 3759 | 3774 | 528890 | CCCTGATAAGGCACCC | e-e-e-d(10)-k-k-k | 42 | 1201 |
| 3760 | 3775 | 528891 | GCCCTGATAAGGCACC | e-e-e-d(10)-k-k-k | 49 | 1202 |
| 3765 | 3780 | 528892 | TCCCAGCCCTGATAAG | e-e-e-d(10)-k-k-k | 0 | 1203 |
| 3767 | 3782 | 528893 | TATCCCAGCCCTGATA | e-e-e-d(10)-k-k-k | 0 | 1204 |
| 3770 | 3785 | 528894 | AAGTATCCCAGCCCTG | e-e-e-d(10)-k-k-k | 25 | 1205 |
| 3771 | 3786 | 528895 | GAAGTATCCCAGCCCT | e-e-e-d(10)-k-k-k | 39 | 1206 |
| 3772 | 3787 | 528896 | AGAAGTATCCCAGCCC | e-e-e-d(10)-k-k-k | 22 | 1207 |
| 3773 | 3788 | 528897 | CAGAAGTATCCCAGCC | e-e-e-d(10)-k-k-k | 36 | 1208 |
| 3892 | 3907 | 528898 | TGAGACCAGGATTCCT | e-e-e-d(10)-k-k-k | 41 | 1209 |
| 3896 | 3911 | 528899 | GTCCTGAGACCAGGAT | e-e-e-d(10)-k-k-k | 19 | 1210 |
| 3977 | 3992 | 528900 | AGCTCAACCAGACACG | e-e-e-d(10)-k-k-k | 54 | 311 |
| 3979 | 3994 | 528901 | TGAGCTCAACCAGACA | e-e-e-d(10)-k-k-k | 40 | 1211 |
| 3984 | 3999 | 528902 | TTCCCTGAGCTCAACC | e-e-e-d(10)-k-k-k | 32 | 1212 |
| 3992 | 4007 | 528903 | GAACCATATTCCCTGA | e-e-e-d(10)-k-k-k | 30 | 313 |
| 3995 | 4010 | 528904 | TAAGAACCATATTCCC | e-e-e-d(10)-k-k-k | 27 | 1213 |
| 4022 | 4037 | 518344 | GCCACTGGATATCACC | e-e-e-d(10)-k-k-k | 89 | 317 |
| 4067 | 4082 | 528905 | TAAGCCTTTGCCCTGC | e-e-e-d(10)-k-k-k | 64 | 1214 |
| 4068 | 4083 | 528906 | GTAAGCCTTTGCCCTG | e-e-e-d(10)-k-k-k | 53 | 1215 |
| 4069 | 4084 | 528907 | AGTAAGCCTTTGCCCT | e-e-e-d(10)-k-k-k | 45 | 1216 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 4070 | 4085 | 528908 | CAGTAAGCCTTTGCCC | e-e-e-d(10)-k-k-k | 40 | 1217 |
| 4072 | 4087 | 528909 | ATCAGTAAGCCTTTGC | e-e-e-d(10)-k-k-k | 53 | 1218 |
| 4073 | 4088 | 528910 | TATCAGTAAGCCTTTG | e-e-e-d(10)-k-k-k | 47 | 1219 |
| 4077 | 4092 | 528911 | AGTTTATCAGTAAGCC | e-e-e-d(10)-k-k-k | 58 | 1220 |
| 4083 | 4098 | 528912 | GACTCAAGTTTATCAG | e-e-e-d(10)-k-k-k | 37 | 1221 |
| 4085 | 4100 | 528913 | CAGACTCAAGTTTATC | e-e-e-d(10)-k-k-k | 39 | 1222 |
| 4086 | 4101 | 528914 | GCAGACTCAAGTTTAT | e-e-e-d(10)-k-k-k | 0 | 1223 |
| 4087 | 4102 | 528915 | GGCAGACTCAAGTTTA | e-e-e-d(10)-k-k-k | 1 | 1224 |
| 4088 | 4103 | 528916 | GGGCAGACTCAAGTTT | e-e-e-d(10)-k-k-k | 0 | 1225 |
| 4089 | 4104 | 528917 | AGGGCAGACTCAAGTT | e-e-e-d(10)-k-k-k | 9 | 1226 |
| 4091 | 4106 | 528918 | CGAGGGCAGACTCAAG | e-e-e-d(10)-k-k-k | 2 | 1227 |
| 4093 | 4108 | 528919 | TACGAGGGCAGACTCA | e-e-e-d(10)-k-k-k | 20 | 324 |
| 4094 | 4109 | 528920 | ATACGAGGGCAGACTC | e-e-e-d(10)-k-k-k | 14 | 1228 |
| 4095 | 4110 | 528921 | CATACGAGGGCAGACT | e-e-e-d(10)-k-k-k | 0 | 1229 |
| 4096 | 4111 | 528922 | TCATACGAGGGCAGAC | e-e-e-d(10)-k-k-k | 8 | 1230 |
| 4098 | 4113 | 528923 | CCTCATACGAGGGCAG | e-e-e-d(10)-k-k-k | 2 | 1231 |
| 4099 | 4114 | 528924 | CCCTCATACGAGGGCA | e-e-e-d(10)-k-k-k | 2 | 1232 |
| 4100 | 4115 | 528925 | ACCCTCATACGAGGGC | e-e-e-d(10)-k-k-k | 0 | 1233 |
| 4225 | 4240 | 528926 | TACGCACAGGAGAGGC | e-e-e-d(10)-k-k-k | 20 | 1233 |
| 4226 | 4241 | 528927 | ATACGCACAGGAGAGG | e-e-e-d(10)-k-k-k | 0 | 1234 |
| 4227 | 4242 | 528928 | CATACGCACAGGAGAG | e-e-e-d(10)-k-k-k | 6 | 1235 |
| 4228 | 4243 | 528929 | CCATACGCACAGGAGA | e-e-e-d(10)-k-k-k | 4 | 1236 |
| 4229 | 4244 | 528930 | CCCATACGCACAGGAG | e-e-e-d(10)-k-k-k | 36 | 1237 |
| 4230 | 4245 | 528931 | TCCCATACGCACAGGA | e-e-e-d(10)-k-k-k | 22 | 1238 |
| 4231 | 4246 | 528932 | TTCCCATACGCACAGG | e-e-e-d(10)-k-k-k | 32 | 1239 |
| 4232 | 4247 | 528933 | GTTCCCATACGCACAG | e-e-e-d(10)-k-k-k | 45 | 1240 |
| 4233 | 4248 | 528934 | TGTTCCCATACGCACA | e-e-e-d(10)-k-k-k | 36 | 1241 |
| 4234 | 4249 | 528935 | GTGTTCCCATACGCAC | e-e-e-d(10)-k-k-k | 20 | 1242 |
| 4234 | 4249 | 530395 | GTGTTCCCATACGCAC | k-d(10)-k-e-k-e-e | 71 | 1242 |
| 4235 | 4250 | 528936 | GGTGTTCCCATACGCA | e-e-e-d(10)-k-k-k | 71 | 1243 |
| 4235 | 4251 | 530025 | AGGTGTTCCCATACGCA | e-e-k-d(10)-k-e-k-e | 90 | 1244 |
| 4235 | 4250 | 530345 | GGTGTTCCCATACGCA | e-k-d(10)-k-e-k-e | 93 | 1243 |
| 4235 | 4250 | 530396 | GGTGTTCCCATACGCA | k-d(10)-k-e-k-e-e | 71 | 1243 |
| 4236 | 4251 | 528937 | AGGTGTTCCCATACGC | e-e-e-d(10)-k-k-k | 73 | 1245 |
| 4236 | 4252 | 530026 | TAGGTGTTCCCATACGC | e-e-k-d(10)-k-e-k-e | 87 | 1246 |
| 4236 | 4251 | 530093 | AGGTGTTCCCATACGC | e-k-k-d(10)-k-k-e | 95 | 1245 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 4236 | 4251 | 530140 | AGGTGTTCCCATACGC | e-e-k-d(10)-k-k-e | 89 | 1245 |
| 4236 | 4251 | 530190 | AGGTGTTCCCATACGC | e-d-k-d(10)-k-k-e | 82 | 1245 |
| 4236 | 4251 | 530240 | AGGTGTTCCCATACGC | e-d-d-k-d(9)-k-k-e | 50 | 1245 |
| 4236 | 4251 | 530290 | AGGTGTTCCCATACGC | e-e-e-e-d(9)-k-k-e | 69 | 1245 |
| 4236 | 4251 | 530346 | AGGTGTTCCCATACGC | e-k-d(10)-k-e-k-e | 89 | 1245 |
| 4237 | 4252 | 528938 | TAGGTGTTCCCATACG | e-e-e-d(10)-k-k-k | 72 | 336 |
| 4237 | 4252 | 530094 | TAGGTGTTCCCATACG | e-k-k-d(10)-k-k-e | 88 | 336 |
| 4237 | 4252 | 530141 | TAGGTGTTCCCATACG | e-e-k-d(10)-k-k-e | 80 | 336 |
| 4237 | 4252 | 530191 | TAGGTGTTCCCATACG | e-d-k-d(10)-k-k-e | 74 | 336 |
| 4237 | 4252 | 530241 | TAGGTGTTCCCATACG | e-d-d-k-d(9)-k-k-e | 53 | 336 |
| 4237 | 4252 | 530291 | TAGGTGTTCCCATACG | e-e-e-e-d(9)-k-k-e | 68 | 336 |
| 4238 | 4253 | 528939 | CTAGGTGTTCCCATAC | e-e-e-d(10)-k-k-k | 39 | 1247 |
| 4239 | 4254 | 528940 | GCTAGGTGTTCCCATA | e-e-e-d(10)-k-k-k | 62 | 1248 |
| 4240 | 4255 | 528941 | TGCTAGGTGTTCCCAT | e-e-e-d(10)-k-k-k | 49 | 1249 |
| 4242 | 4257 | 528942 | CGTGCTAGGTGTTCCC | e-e-e-d(10)-k-k-k | 77 | 1250 |
| 4304 | 4319 | 528943 | CAAGGTGGTTTTGAGT | e-e-e-d(10)-k-k-k | 25 | 1251 |
| 4305 | 4320 | 528944 | GCAAGGTGGTTTTGAG | e-e-e-d(10)-k-k-k | 28 | 344 |
| 4320 | 4335 | 528945 | CTCTGATCAGCTGAGG | e-e-e-d(10)-k-k-k | 74 | 1252 |
| 4321 | 4336 | 528946 | ACTCTGATCAGCTGAG | e-e-e-d(10)-k-k-k | 56 | 1253 |
| 4362 | 4377 | 528947 | GAGACCAGCTAATTTG | e-e-e-d(10)-k-k-k | 36 | 1254 |
| 4395 | 4410 | 528948 | CATCTTAGAGAAGGTC | e-e-e-d(10)-k-k-k | 59 | 1255 |
| 4435 | 4450 | 528949 | TCAACTGTCTCCAGGC | e-e-e-d(10)-k-k-k | 67 | 1256 |
| 4435 | 4450 | 530397 | TCAACTGTCTCCAGGC | k-d(10)-k-e-k-e-e | 60 | 1256 |
| 4436 | 4451 | 528950 | ATCAACTGTCTCCAGG | e-e-e-d(10)-k-k-k | 57 | 1257 |
| 4436 | 4452 | 530027 | CATCAACTGTCTCCAGG | e-e-k-d(10)-k-e-k-e | 56 | 1258 |
| 4436 | 4451 | 530347 | ATCAACTGTCTCCAGG | e-k-d(10)-k-e-k-e | 49 | 1257 |
| 4437 | 4452 | 530095 | CATCAACTGTCTCCAG | e-k-k-d(10)-k-k-e | 40 | 354 |
| 4437 | 4452 | 530142 | CATCAACTGTCTCCAG | e-e-k-d(10)-k-k-e | 43 | 354 |
| 4437 | 4452 | 530192 | CATCAACTGTCTCCAG | e-d-k-d(10)-k-k-e | 42 | 354 |
| 4437 | 4452 | 530242 | CATCAACTGTCTCCAG | e-d-d-k-d(9)-k-k-e | 0 | 354 |
| 4437 | 4452 | 530292 | CATCAACTGTCTCCAG | e-e-e-e-d(9)-k-k-e | 36 | 354 |
| 4437 | 4452 | 530398 | CATCAACTGTCTCCAG | k-d(10)-k-e-k-e-e | 28 | 354 |
| 4438 | 4454 | 530028 | CACATCAACTGTCTCCA | e-e-k-d(10)-k-e-k-e | 57 | 1259 |
| 4438 | 4453 | 530348 | ACATCAACTGTCTCCA | e-k-d(10)-k-e-k-e | 58 | 1260 |
| 4439 | 4454 | 530096 | CACATCAACTGTCTCC | e-k-k-d(10)-k-k-e | 72 | 356 |
| 4439 | 4454 | 530143 | CACATCAACTGTCTCC | e-e-k-d(10)-k-k-e | 74 | 356 |
| 4439 | 4454 | 530193 | CACATCAACTGTCTCC | e-d-k-d(10)-k-k-e | 62 | 356 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 4439 | 4454 | 530243 | CACATCAACTGTCTCC | e-d-d-k-d(9)-k-k-e | 34 | 356 |
| 4439 | 4454 | 530293 | CACATCAACTGTCTCC | e-e-e-e-d(9)-k-k-e | 59 | 356 |
| 4441 | 4456 | 528951 | GACACATCAACTGTCT | e-e-e-d(10)-k-k-k | 16 | 1261 |
| 4475 | 4490 | 528952 | GAAGAGTGTTGCTGGA | e-e-e-d(10)-k-k-k | 57 | 1262 |
| 4477 | 4492 | 528953 | CTGAAGAGTGTTGCTG | e-e-e-d(10)-k-k-k | 46 | 1263 |
| 4479 | 4494 | 528954 | TACTGAAGAGTGTTGC | e-e-e-d(10)-k-k-k | 42 | 1264 |
| 4485 | 4500 | 530510 | ATTATGTACTGAAGAG | k-d(10)-k-e-k-e-e | 53 | 1265 |
| 4486 | 4501 | 530504 | TATTATGTACTGAAGA | e-k-d(10)-k-e-k-e | 25 | 1266 |
| 4486 | 4501 | 530511 | TATTATGTACTGAAGA | k-d(10)-k-e-k-e-e | 31 | 1266 |
| 4487 | 4502 | 530432 | TTATTATGTACTGAAG | k-d(10)-k-e-k-e-e | 15 | 1267 |
| 4487 | 4502 | 530463 | TTATTATGTACTGAAG | e-k-k-d(10)-k-k-e | 20 | 1267 |
| 4487 | 4502 | 530472 | TTATTATGTACTGAAG | e-e-k-d(10)-k-k-e | 17 | 1267 |
| 4487 | 4502 | 530480 | TTATTATGTACTGAAG | e-d-k-d(10)-k-k-e | 4 | 1267 |
| 4487 | 4502 | 530488 | TTATTATGTACTGAAG | e-d-d-k-d(9)-k-k-e | 13 | 1267 |
| 4487 | 4502 | 530496 | TTATTATGTACTGAAG | e-e-e-e-d(9)-k-k-e | 0 | 1267 |
| 4487 | 4502 | 530505 | TTATTATGTACTGAAG | e-k-d(10)-k-e-k-e | 37 | 1267 |
| 4488 | 4504 | 530063 | GCTTATTATGTACTGAA | e-e-k-d(10)-k-e-k-e | 74 | 1268 |
| 4488 | 4503 | 530382 | CTTATTATGTACTGAA | e-k-d(10)-k-e-k-e | 17 | 1269 |
| 4488 | 4503 | 530465 | CTTATTATGTACTGAA | e-k-k-d(10)-k-k-e | 63 | 1269 |
| 4488 | 4503 | 530473 | CTTATTATGTACTGAA | e-e-k-d(10)-k-k-e | 45 | 1269 |
| 4488 | 4503 | 530481 | CTTATTATGTACTGAA | e-d-k-d(10)-k-k-e | 14 | 1269 |
| 4488 | 4503 | 530489 | CTTATTATGTACTGAA | e-d-d-k-d(9)-k-k-e | 13 | 1269 |
| 4488 | 4503 | 530497 | CTTATTATGTACTGAA | e-e-e-e-d(9)-k-k-e | 7 | 1269 |
| 4488 | 4503 | 530512 | CTTATTATGTACTGAA | k-d(10)-k-e-k-e-e | 21 | 1269 |
| 4489 | 4504 | 519638 | GCTTATTATGTACTGA | e-k-k-d(10)-k-k-e | 86 | 362 |
| 4489 | 4504 | 530177 | GCTTATTATGTACTGA | e-e-e-d(10)-k-k-e | 71 | 362 |
| 4489 | 4504 | 530227 | GCTTATTATGTACTGA | e-d-k-d(10)-k-k-e | 51 | 362 |
| 4489 | 4504 | 530277 | GCTTATTATGTACTGA | e-d-d-k-d(9)-k-k-e | 70 | 362 |
| 4489 | 4504 | 530327 | GCTTATTATGTACTGA | e-e-e-e-d(9)-k-k-e | 61 | 362 |
| 4490 | 4505 | 530466 | AGCTTATTATGTACTG | e-k-k-d(10)-k-k-e | 82 | 1270 |
| 4490 | 4505 | 530474 | AGCTTATTATGTACTG | e-e-k-d(10)-k-k-e | 62 | 1270 |
| 4490 | 4505 | 530482 | AGCTTATTATGTACTG | e-d-k-d(10)-k-k-e | 53 | 1270 |
| 4490 | 4505 | 530490 | AGCTTATTATGTACTG | e-d-d-k-d(9)-k-k-e | 42 | 1270 |
| 4490 | 4505 | 530498 | AGCTTATTATGTACTG | e-e-e-e-d(9)-k-k-e | 45 | 1270 |
| 4490 | 4505 | 530506 | AGCTTATTATGTACTG | e-k-d(10)-k-e-k-e | 70 | 1270 |
| 4491 | 4506 | 530467 | AAGCTTATTATGTACT | e-k-k-d(10)-k-k-e | 50 | 1271 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 4491 | 4506 | 530475 | AAGCTTATTATGTACT | e-e-k-d(10)-k-k-e | 26 | 1271 |
| 4491 | 4506 | 530483 | AAGCTTATTATGTACT | e-d-k-d(10)-k-k-e | 19 | 1271 |
| 4491 | 4506 | 530491 | AAGCTTATTATGTACT | e-d-d-k-d(9)-k-k-e | 13 | 1271 |
| 4491 | 4506 | 530499 | AAGCTTATTATGTACT | e-e-e-e-d(9)-k-k-e | 15 | 1271 |
| 4492 | 4507 | 528955 | TAAGCTTATTATGTAC | e-e-e-d(10)-k-k-k | 0 | 1272 |
| 4499 | 4514 | 528956 | TATCAGTTAAGCTTAT | e-e-e-d(10)-k-k-k | 0 | 1273 |
| 4502 | 4517 | 528957 | GTTTATCAGTTAAGCT | e-e-e-d(10)-k-k-k | 31 | 1274 |
| 4539 | 4554 | 530433 | CAATGGTAAGCCCAAG | k-d(10)-k-e-k-e-e | 62 | 1275 |
| 4540 | 4555 | 528958 | CCAATGGTAAGCCCAA | e-e-e-d(10)-k-k-k | 66 | 1276 |
| 4540 | 4556 | 530056 | CCCAATGGTAAGCCCAA | e-e-k-d(10)-k-e-k-e | 73 | 1277 |
| 4540 | 4555 | 530383 | CCAATGGTAAGCCCAA | e-k-d(10)-k-e-k-e | 64 | 1276 |
| 4541 | 4556 | 518345 | CCCAATGGTAAGCCCA | e-e-e-d(10)-k-k-k | 80 | 366 |
| 4541 | 4556 | 519636 | CCCAATGGTAAGCCCA | e-k-k-d(10)-k-k-e | 90 | 366 |
| 4541 | 4556 | 530178 | CCCAATGGTAAGCCCA | e-e-k-d(10)-k-k-e | 86 | 366 |
| 4541 | 4556 | 530228 | CCCAATGGTAAGCCCA | e-d-k-d(10)-k-k-e | 77 | 366 |
| 4541 | 4556 | 530278 | CCCAATGGTAAGCCCA | e-d-d-k-d(9)-k-k-e | 86 | 366 |
| 4541 | 4556 | 530328 | CCCAATGGTAAGCCCA | e-e-e-e-d(9)-k-k-e | 80 | 366 |
| 4542 | 4557 | 528959 | ACCCAATGGTAAGCCC | e-e-e-d(10)-k-k-k | 73 | 1277 |
| 4544 | 4559 | 528960 | AAACCCAATGGTAAGC | e-e-e-d(10)-k-k-k | 43 | 1278 |
| 4545 | 4560 | 528961 | TAAACCCAATGGTAAG | e-e-e-d(10)-k-k-k | 18 | 1279 |
| 4546 | 4561 | 528962 | TTAAACCCAATGGTAA | e-e-e-d(10)-k-k-k | 13 | 1280 |
| 4547 | 4562 | 528963 | TTTAAACCCAATGGTA | e-e-e-d(10)-k-k-k | 2 | 1281 |
| 4554 | 4569 | 528964 | CCTATGATTTAAACCC | e-e-e-d(10)-k-k-k | 17 | 1282 |
| 4558 | 4573 | 528965 | GGTCCCTATGATTTAA | e-e-e-d(10)-k-k-k | 31 | 1283 |
| 4559 | 4574 | 528966 | AGGTCCCTATGATTTA | e-e-e-d(10)-k-k-k | 22 | 1284 |
| 4615 | 4630 | 528967 | CCTAAGGCCATGAACT | e-e-e-d(10)-k-k-k | 19 | 374 |
| 4616 | 4631 | 528968 | ACCTAAGGCCATGAAC | e-e-e-d(10)-k-k-k | 25 | 1285 |
| 4617 | 4632 | 528969 | TACCTAAGGCCATGAA | e-e-e-d(10)-k-k-k | 41 | 1286 |
| 4618 | 4633 | 528970 | CTACCTAAGGCCATGA | e-e-e-d(10)-k-k-k | 55 | 1287 |
| 4619 | 4634 | 528971 | GCTACCTAAGGCCATG | e-e-e-d(10)-k-k-k | 66 | 1288 |
| 4620 | 4635 | 528972 | TGCTACCTAAGGCCAT | e-e-e-d(10)-k-k-k | 56 | 1289 |
| 4621 | 4636 | 528973 | ATGCTACCTAAGGCCA | e-e-e-d(10)-k-k-k | 71 | 1290 |
| 4622 | 4637 | 528974 | CATGCTACCTAAGGCC | e-e-e-d(10)-k-k-k | 58 | 1291 |
| 4623 | 4638 | 528975 | ACATGCTACCTAAGGC | e-e-e-d(10)-k-k-k | 34 | 1292 |
| 4636 | 4651 | 528976 | GTTAAGACCAGATACA | e-e-e-d(10)-k-k-k | 45 | 1293 |
| 4637 | 4652 | 528977 | AGTTAAGACCAGATAC | e-e-e-d(10)-k-k-k | 40 | 1294 |
| 4638 | 4653 | 528978 | GAGTTAAGACCAGATA | e-e-e-d(10)-k-k-k | 40 | 1295 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 4639 | 4654 | 528979 | AGAGTTAAGACCAGAT | e-e-e-d(10)-k-k-k | 62 | 1296 |
| 4644 | 4659 | 530399 | CAATCAGAGTTAAGAC | k-d(10)-k-e-k-e-e | 36 | 1297 |
| 4645 | 4661 | 530029 | TACAATCAGAGTTAAGA | e-e-k-d(10)-k-e-k-e | 29 | 1298 |
| 4645 | 4660 | 530349 | ACAATCAGAGTTAAGA | e-k-d(10)-k-e-k-e | 33 | 1299 |
| 4646 | 4661 | 528980 | TACAATCAGAGTTAAG | e-e-e-d(10)-k-k-k | 0 | 378 |
| 4646 | 4661 | 530097 | TACAATCAGAGTTAAG | e-k-k-d(10)-k-k-e | 41 | 378 |
| 4646 | 4661 | 530144 | TACAATCAGAGTTAAG | e-e-k-d(10)-k-k-e | 16 | 378 |
| 4646 | 4661 | 530194 | TACAATCAGAGTTAAG | e-d-k-d(10)-k-k-e | 28 | 378 |
| 4646 | 4661 | 530244 | TACAATCAGAGTTAAG | e-d-d-k-d(9)-k-k-e | 0 | 378 |
| 4646 | 4661 | 530294 | TACAATCAGAGTTAAG | e-e-e-e-d(9)-k-k-e | 7 | 378 |
| 4648 | 4663 | 528981 | GCTACAATCAGAGTTA | e-e-e-d(10)-k-k-k | 52 | 1300 |
| 4649 | 4664 | 528982 | TGCTACAATCAGAGTT | e-e-e-d(10)-k-k-k | 47 | 1301 |
| 4650 | 4665 | 528983 | TTGCTACAATCAGAGT | e-e-e-d(10)-k-k-k | 44 | 1302 |
| 4662 | 4677 | 530400 | CTCTCAGAACTTTTGC | k-d(10)-k-e-k-e-e | 65 | 1303 |
| 4663 | 4679 | 530030 | TCCTCTCAGAACTTTTG | e-e-k-d(10)-k-e-k-e | 47 | 1304 |
| 4663 | 4678 | 530350 | CCTCTCAGAACTTTTG | e-k-d(10)-k-e-k-e | 54 | 1305 |
| 4664 | 4679 | 530098 | TCCTCTCAGAACTTTT | e-k-k-d(10)-k-k-e | 42 | 380 |
| 4664 | 4679 | 530145 | TCCTCTCAGAACTTTT | e-e-k-d(10)-k-k-e | 38 | 380 |
| 4664 | 4679 | 530195 | TCCTCTCAGAACTTTT | e-d-k-d(10)-k-k-e | 43 | 380 |
| 4664 | 4679 | 530245 | TCCTCTCAGAACTTTT | e-d-d-k-d(9)-k-k-e | 28 | 380 |
| 4664 | 4679 | 530295 | TCCTCTCAGAACTTTT | e-e-e-e-d(9)-k-k-e | 39 | 380 |
| 4770 | 4785 | 528984 | CCCACGGGATTCCCTC | e-e-e-d(10)-k-k-k | 39 | 1306 |
| 4771 | 4786 | 528985 | ACCCACGGGATTCCCT | e-e-e-d(10)-k-k-k | 36 | 1307 |
| 4772 | 4787 | 528986 | AACCCACGGGATTCCC | e-e-e-d(10)-k-k-k | 47 | 1308 |
| 4773 | 4788 | 528987 | CAACCCACGGGATTCC | e-e-e-d(10)-k-k-k | 39 | 1309 |
| 4774 | 4789 | 528988 | GCAACCCACGGGATTC | e-e-e-d(10)-k-k-k | 48 | 1310 |
| 4775 | 4790 | 528989 | AGCAACCCACGGGATT | e-e-e-d(10)-k-k-k | 40 | 1311 |
| 4777 | 4792 | 528990 | TAAGCAACCCACGGGA | e-e-e-d(10)-k-k-k | 27 | 1312 |
| 4778 | 4793 | 528991 | GTAAGCAACCCACGGG | e-e-e-d(10)-k-k-k | 47 | 1313 |
| 4779 | 4794 | 528992 | GGTAAGCAACCCACGG | e-e-e-d(10)-k-k-k | 42 | 1314 |
| 4780 | 4795 | 528993 | AGGTAAGCAACCCACG | e-e-e-d(10)-k-k-k | 54 | 1315 |
| 4780 | 4795 | 530434 | AGGTAAGCAACCCACG | k-d(10)-k-e-k-e-e | 51 | 1315 |
| 4781 | 4796 | 528994 | TAGGTAAGCAACCCAC | e-e-e-d(10)-k-k-k | 53 | 1316 |
| 4781 | 4797 | 530064 | GTAGGTAAGCAACCCAC | e-e-k-d(10)-k-e-k-e | 53 | 1317 |
| 4781 | 4796 | 530384 | TAGGTAAGCAACCCAC | e-k-d(10)-k-e-k-e | 48 | 1316 |
| 4782 | 4797 | 528995 | GTAGGTAAGCAACCCA | e-e-e-d(10)-k-k-k | 64 | 388 |

TABLE 13-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 4782 | 4797 | 530129 | GTAGGTAAGCAACCCA | e-k-k-d(10)-k-k-e | 79 | 388 |
| 4782 | 4797 | 530179 | GTAGGTAAGCAACCCA | e-e-k-d(10)-k-k-e | 74 | 388 |
| 4782 | 4797 | 530229 | GTAGGTAAGCAACCCA | e-d-k-d(10)-k-k-e | 64 | 388 |
| 4782 | 4797 | 530279 | GTAGGTAAGCAACCCA | e-d-d-k-d(9)-k-k-e | 55 | 388 |
| 4782 | 4797 | 530329 | GTAGGTAAGCAACCCA | e-e-e-e-d(9)-k-k-e | 61 | 388 |
| 4784 | 4799 | 528996 | AGGTAGGTAAGCAACC | e-e-e-d(10)-k-k-k | 21 | 1318 |
| 4788 | 4803 | 528997 | TTATAGGTAGGTAAGC | e-e-e-d(10)-k-k-k | 10 | 1319 |
| 4792 | 4807 | 528998 | CACCTTATAGGTAGGT | e-e-e-d(10)-k-k-k | 22 | 1320 |
| 4794 | 4809 | 528999 | ACCACCTTATAGGTAG | e-e-e-d(10)-k-k-k | 15 | 1321 |
| 4797 | 4812 | 529000 | TAAACCACCTTATAGG | e-e-e-d(10)-k-k-k | 0 | 1322 |
| 4798 | 4813 | 529001 | ATAAACCACCTTATAG | e-e-e-d(10)-k-k-k | 7 | 1323 |
| 4810 | 4825 | 529002 | GGACAGCAGCTTATAA | e-e-e-d(10)-k-k-k | 12 | 1324 |
| 4811 | 4826 | 529003 | AGGACAGCAGCTTATA | e-e-e-d(10)-k-k-k | 40 | 1325 |
| 4811 | 4826 | 530401 | AGGACAGCAGCTTATA | k-d(10)-k-e-k-e-e | 41 | 1325 |
| 4812 | 4827 | 529004 | CAGGACAGCAGCTTAT | e-e-e-d(10)-k-k-k | 38 | 1326 |
| 4812 | 4828 | 530031 | CCAGGACAGCAGCTTAT | e-e-k-d(10)-k-e-k-e | 58 | 1327 |
| 4812 | 4827 | 530351 | CAGGACAGCAGCTTAT | e-k-d(10)-k-e-k-e | 58 | 1326 |
| 4812 | 4827 | 530402 | CAGGACAGCAGCTTAT | k-d(10)-k-e-k-e-e | 60 | 1326 |
| 4813 | 4829 | 530032 | GCCAGGACAGCAGCTTA | e-e-k-d(10)-k-e-k-e | 74 | 1328 |
| 4813 | 4828 | 530099 | CCAGGACAGCAGCTTA | e-k-k-d(10)-k-k-e | 73 | 1329 |
| 4813 | 4828 | 530146 | CCAGGACAGCAGCTTA | e-e-k-d(10)-k-k-e | 70 | 1329 |
| 4813 | 4828 | 530196 | CCAGGACAGCAGCTTA | e-d-k-d(10)-k-k-e | 67 | 1329 |
| 4813 | 4828 | 530246 | CCAGGACAGCAGCTTA | e-d-d-k-d(9)-k-k-e | 39 | 1329 |
| 4813 | 4828 | 530296 | CCAGGACAGCAGCTTA | e-e-e-e-d(9)-k-k-e | 67 | 1329 |
| 4813 | 4828 | 530352 | CCAGGACAGCAGCTTA | e-k-d(10)-k-e-k-e | 67 | 1329 |
| 4814 | 4829 | 530100 | GCCAGGACAGCAGCTT | e-k-k-d(10)-k-k-e | 77 | 1330 |
| 4814 | 4829 | 530147 | GCCAGGACAGCAGCTT | e-e-k-d(10)-k-k-e | 84 | 1330 |
| 4814 | 4829 | 530197 | GCCAGGACAGCAGCTT | e-d-k-d(10)-k-k-e | 71 | 1330 |
| 4814 | 4829 | 530247 | GCCAGGACAGCAGCTT | e-d-d-k-d(9)-k-k-e | 53 | 1330 |
| 4814 | 4829 | 530297 | GCCAGGACAGCAGCTT | e-e-e-e-d(9)-k-k-e | 75 | 1330 |
| 4814 | 4829 | 530403 | GCCAGGACAGCAGCTT | k-d(10)-k-e-k-e-e | 77 | 1330 |
| 4815 | 4831 | 530033 | TGGCCAGGACAGCAGCT | e-e-k-d(10)-k-e-k-e | 65 | 1331 |
| 4815 | 4830 | 530353 | GGCCAGGACAGCAGCT | e-k-d(10)-k-e-k-e | 83 | 1332 |
| 4816 | 4831 | 530101 | TGGCCAGGACAGCAGC | e-k-k-d(10)-k-k-e | 59 | 1333 |
| 4816 | 4831 | 530148 | TGGCCAGGACAGCAGC | e-e-k-d(10)-k-k-e | 79 | 1333 |
| 4816 | 4831 | 530198 | TGGCCAGGACAGCAGC | e-d-k-d(10)-k-k-e | 54 | 1333 |
| 4816 | 4831 | 530248 | TGGCCAGGACAGCAGC | e-d-d-k-d(9)-k-k-e | 32 | 1333 |

TABLE 13-continued

Inhibition of human STAT3 mRNA levels by chimeric antisense
oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 4816 | 4831 | 530298 | TGGCCAGGACAGCAGC | e-e-e-e-d(9)-k-k-e | 73 | 1333 |
| 4827 | 4842 | 530404 | TTTGAATGCAGTGGCC | k-d(10)-k-e-k-e-e | 67 | 1334 |
| 4828 | 4844 | 530034 | AATTTGAATGCAGTGGC | e-e-k-d(10)-k-e-k-e | 69 | 1335 |
| 4828 | 4843 | 530354 | ATTTGAATGCAGTGGC | e-k-d(10)-k-e-k-e | 85 | 1336 |
| 4828 | 4843 | 530405 | ATTTGAATGCAGTGGC | k-d(10)-k-e-k-e-e | 55 | 1336 |
| 4829 | 4845 | 530035 | GAATTTGAATGCAGTGG | e-e-k-d(10)-k-e-k-e | 69 | 1337 |
| 4829 | 4844 | 530102 | AATTTGAATGCAGTGG | e-k-k-d(10)-k-k-e | 71 | 1338 |
| 4829 | 4844 | 530149 | AATTTGAATGCAGTGG | e-e-k-d(10)-k-k-e | 70 | 1338 |
| 4829 | 4844 | 530199 | AATTTGAATGCAGTGG | e-d-k-d(10)-k-k-e | 58 | 1338 |
| 4829 | 4844 | 530249 | AATTTGAATGCAGTGG | e-d-d-k-d(9)-k-k-e | 47 | 1338 |
| 4829 | 4844 | 530299 | AATTTGAATGCAGTGG | e-e-e-d(9)-k-k-e | 47 | 1338 |
| 4829 | 4844 | 530355 | AATTTGAATGCAGTGG | e-k-d(10)-k-e-k-e | 72 | 1338 |
| 4830 | 4845 | 530103 | GAATTTGAATGCAGTG | e-k-k-d(10)-k-k-e | 77 | 390 |
| 4830 | 4845 | 530150 | GAATTTGAATGCAGTG | e-e-k-d(10)-k-k-e | 73 | 390 |
| 4830 | 4845 | 530200 | GAATTTGAATGCAGTG | e-d-k-d(10)-k-k-e | 63 | 390 |
| 4830 | 4845 | 530250 | GAATTTGAATGCAGTG | e-d-d-k-d(9)-k-k-e | 59 | 390 |
| 4830 | 4845 | 530300 | GAATTTGAATGCAGTG | e-e-e-d(9)-k-k-e | 65 | 390 |
| 4842 | 4857 | 530435 | AAGTACACATTGGAAT | k-d(10)-k-e-k-e-e | 62 | 1339 |
| 4843 | 4859 | 530057 | TGAAGTACACATTGGAA | e-e-k-d(10)-k-e-k-e | 69 | 1340 |
| 4843 | 4858 | 530385 | GAAGTACACATTGGAA | e-k-d(10)-k-e-k-e | 70 | 1341 |
| 4844 | 4859 | 529005 | TGAAGTACACATTGGA | e-e-e-d(10)-k-k-k | 64 | 392 |
| 4844 | 4859 | 530130 | TGAAGTACACATTGGA | e-k-k-d(10)-k-k-e | 85 | 392 |
| 4844 | 4859 | 530180 | TGAAGTACACATTGGA | e-e-k-d(10)-k-k-e | 82 | 392 |
| 4844 | 4859 | 530230 | TGAAGTACACATTGGA | e-d-k-d(10)-k-k-e | 65 | 392 |
| 4844 | 4859 | 530280 | TGAAGTACACATTGGA | e-d-d-k-d(9)-k-k-e | 75 | 392 |
| 4844 | 4859 | 530330 | TGAAGTACACATTGGA | e-e-e-d(9)-k-k-e | 52 | 392 |
| 4852 | 4867 | 529006 | TTACACTATGAAGTAC | e-e-e-d(10)-k-k-k | 16 | 1342 |
| 4929 | 4944 | 529007 | AGTTAAAGTAGATACA | e-e-e-d(10)-k-k-k | 0 | 1343 |
| 4934 | 4949 | 529008 | CTGGAAGTTAAAGTAG | e-e-e-d(10)-k-k-k | 30 | 397 |
| 4943 | 4958 | 529009 | CGTTTATTTCTGGAAG | e-e-e-d(10)-k-k-k | 52 | 1344 |
| 4957 | 4972 | 529010 | CGGTTCCTATATAACG | e-e-e-d(10)-k-k-k | 21 | 1345 |
| 4958 | 4973 | 529011 | ACGGTTCCTATATAAC | e-e-e-d(10)-k-k-k | 10 | 1346 |

TABLE 14

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 1359 | 1374 | 529012 | GTCATCCCGAAGAGTC | e-e-e-d(10)-k-k-k | 34 | 1347 |
| 1386 | 1401 | 529013 | CCCGAGTCCCTTCCGA | e-e-e-d(10)-k-k-k | 18 | 1348 |
| 1390 | 1405 | 529014 | GCGCCCCGAGTCCCTT | e-e-e-d(10)-k-k-k | 53 | 1349 |
| 1412 | 1427 | 529015 | CGAAGAACGAAACTTC | e-e-e-d(10)-k-k-k | 8 | 1350 |
| 1418 | 1433 | 529016 | TTTCTCCGAAGAACGA | e-e-e-d(10)-k-k-k | 31 | 1351 |
| 1461 | 1476 | 529017 | CGAGTGCGCCCTCGCC | e-e-e-d(10)-k-k-k | 52 | 1352 |
| 1548 | 1563 | 529018 | GTGACAGTCGCTCCGG | e-e-e-d(10)-k-k-k | 30 | 1353 |
| 1549 | 1564 | 529019 | CGTGACAGTCGCTCCG | e-e-e-d(10)-k-k-k | 31 | 1354 |
| 1590 | 1605 | 529020 | GCGCTTTCCGACCCCC | e-e-e-d(10)-k-k-k | 45 | 1355 |
| 1790 | 1805 | 529021 | GTACCGGTCTGTCAAT | e-e-e-d(10)-k-k-k | 23 | 1356 |
| 1794 | 1809 | 529022 | AAGAGTACCGGTCTGT | e-e-e-d(10)-k-k-k | 69 | 1357 |
| 1796 | 1811 | 529023 | GAAAGAGTACCGGTCT | e-e-e-d(10)-k-k-k | 72 | 1358 |
| 1906 | 1921 | 529024 | CTGGCTTGACGGGTTG | e-e-e-d(10)-k-k-k | 64 | 1359 |
| 1907 | 1922 | 529025 | GCTGGCTTGACGGGTT | e-e-e-d(10)-k-k-k | 73 | 1360 |
| 1966 | 1981 | 529026 | CCGACTTTACCAGGTA | e-e-e-d(10)-k-k-k | 78 | 1361 |
| 1968 | 1983 | 529027 | GGCCGACTTTACCAGG | e-e-e-d(10)-k-k-k | 92 | 1362 |
| 1972 | 1987 | 529028 | TTCTGGCCGACTTTAC | e-e-e-d(10)-k-k-k | 13 | 1363 |
| 2031 | 2046 | 529029 | CGTCCTATGCAATTAA | e-e-e-d(10)-k-k-k | 24 | 1364 |
| 2039 | 2054 | 529030 | GTTCATTCCGTCCTAT | e-e-e-d(10)-k-k-k | 41 | 1365 |
| 2198 | 2213 | 529031 | GACGGTTTGAATCTTG | e-e-e-d(10)-k-k-k | 40 | 1366 |
| 2201 | 2216 | 529032 | GGCGACGGTTTGAATC | e-e-e-d(10)-k-k-k | 37 | 1367 |
| 2204 | 2219 | 529033 | TTGGGCGACGGTTTGA | e-e-e-d(10)-k-k-k | 31 | 1368 |
| 2207 | 2222 | 529034 | AACTTGGGCGACGGTT | e-e-e-d(10)-k-k-k | 54 | 1369 |
| 2253 | 2268 | 529035 | CGACCTGATATGGCAC | e-e-e-d(10)-k-k-k | 56 | 1370 |
| 2255 | 2270 | 529036 | AACGACCTGATATGGC | e-e-e-d(10)-k-k-k | 52 | 1371 |
| 2257 | 2272 | 529037 | ACAACGACCTGATATG | e-e-e-d(10)-k-k-k | 24 | 1372 |
| 2338 | 2353 | 530406 | ATACAGTAAGACCAGC | k-d(10)-k-e-k-e-e | 65 | 1373 |
| 2339 | 2355 | 530036 | ACATACAGTAAGACCAG | e-e-k-d(10)-k-e-k-e | 58 | 1374 |
| 2339 | 2354 | 530356 | CATACAGTAAGACCAG | e-k-d(10)-k-e-k-e | 65 | 1375 |
| 2340 | 2355 | 530104 | ACATACAGTAAGACCA | e-e-k-d(10)-k-e-k-e | 67 | 1376 |
| 2340 | 2355 | 530151 | ACATACAGTAAGACCA | e-e-e-d(10)-k-e-k-e | 64 | 1376 |
| 2340 | 2355 | 530201 | ACATACAGTAAGACCA | e-d-k-d(10)-k-e-k-e | 42 | 1376 |
| 2340 | 2355 | 530251 | ACATACAGTAAGACCA | e-d-d-k-d(9)-k-k-e | 58 | 1376 |
| 2340 | 2355 | 530301 | ACATACAGTAAGACCA | e-e-e-e-d(9)-k-k-e | 56 | 1376 |
| 2383 | 2398 | 530407 | AAAATTTACAACCCAT | k-d(10)-k-e-k-e-e | 9 | 1377 |
| 2384 | 2400 | 530037 | CAAAAATTTACAACCCA | e-e-k-d(10)-k-e-k-e | 42 | 1378 |
| 2384 | 2399 | 530357 | AAAAATTTACAACCCA | e-k-d(10)-k-e-k-e | 34 | 1379 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 2385 | 2400 | 530105 | CAAAAATTTACAACCC | e-k-k-d(10)-k-k-e | 40 | 1380 |
| 2385 | 2400 | 530152 | CAAAAATTTACAACCC | e-e-k-d(10)-k-k-e | 33 | 1380 |
| 2385 | 2400 | 530202 | CAAAAATTTACAACCC | e-d-k-d(10)-k-k-e | 10 | 1380 |
| 2385 | 2400 | 530252 | CAAAAATTTACAACCC | e-d-d-k-d(9)-k-k-e | 29 | 1380 |
| 2385 | 2400 | 530302 | CAAAAATTTACAACCC | e-e-e-e-d(9)-k-k-e | 14 | 1380 |
| 2408 | 2423 | 530408 | AATGCTTTATCAGCAC | k-d(10)-k-e-k-e-e | 36 | 1381 |
| 2409 | 2425 | 530038 | CCAATGCTTTATCAGCA | e-e-k-d(10)-k-e-k-e | 71 | 1382 |
| 2409 | 2424 | 530358 | CAATGCTTTATCAGCA | e-k-d(10)-k-e-k-e | 46 | 1383 |
| 2410 | 2425 | 530106 | CCAATGCTTTATCAGC | e-k-k-d(10)-k-k-e | 70 | 1384 |
| 2410 | 2425 | 530153 | CCAATGCTTTATCAGC | e-e-k-d(10)-k-k-e | 50 | 1384 |
| 2410 | 2425 | 530203 | CCAATGCTTTATCAGC | e-d-k-d(10)-k-k-e | 43 | 1384 |
| 2410 | 2425 | 530253 | CCAATGCTTTATCAGC | e-d-d-k-d(9)-k-k-e | 33 | 1384 |
| 2410 | 2425 | 530303 | CCAATGCTTTATCAGC | e-e-e-e-d(9)-k-k-e | 40 | 1384 |
| 2669 | 2684 | 530409 | ACTAAAATCAAGGCTC | k-d(10)-k-e-k-e-e | 42 | 1385 |
| 2670 | 2686 | 530039 | AGACTAAAATCAAGGCT | e-e-k-d(10)-k-e-k-e | 73 | 1386 |
| 2670 | 2685 | 530359 | GACTAAAATCAAGGCT | e-k-d(10)-k-e-k-e | 82 | 1387 |
| 2671 | 2686 | 530107 | AGACTAAAATCAAGGC | e-k-k-d(10)-k-k-e | 77 | 1388 |
| 2671 | 2686 | 530154 | AGACTAAAATCAAGGC | e-e-k-d(10)-k-k-e | 57 | 1388 |
| 2671 | 2686 | 530204 | AGACTAAAATCAAGGC | e-d-k-d(10)-k-k-e | 28 | 1388 |
| 2671 | 2686 | 530254 | AGACTAAAATCAAGGC | e-d-d-k-d(9)-k-k-e | 3 | 1388 |
| 2671 | 2686 | 530304 | AGACTAAAATCAAGGC | e-e-e-e-d(9)-k-k-e | 22 | 1388 |
| 2703 | 2718 | 530429 | AATGGTTCTTTGTGAT | k-d(10)-k-e-k-e-e | 60 | 1389 |
| 2704 | 2720 | 530065 | CTAATGGTTCTTTGTGA | e-e-k-d(10)-k-e-k-e | 70 | 1390 |
| 2704 | 2719 | 530379 | TAATGGTTCTTTGTGA | e-k-d(10)-k-e-k-e | 54 | 1391 |
| 2705 | 2720 | 530127 | CTAATGGTTCTTTGTG | e-k-k-d(10)-k-k-e | 80 | 411 |
| 2705 | 2720 | 530174 | CTAATGGTTCTTTGTG | e-e-k-d(10)-k-k-e | 69 | 411 |
| 2705 | 2720 | 530224 | CTAATGGTTCTTTGTG | e-d-k-d(10)-k-k-e | 32 | 411 |
| 2705 | 2720 | 530274 | CTAATGGTTCTTTGTG | e-d-d-k-d(9)-k-k-e | 38 | 411 |
| 2705 | 2720 | 530324 | CTAATGGTTCTTTGTG | e-e-e-e-d(9)-k-k-e | 32 | 411 |
| 5000 | 5015 | 530410 | CTGAAATTCCTTGGTC | k-d(10)-k-e-k-e-e | 53 | 1392 |
| 5001 | 5017 | 530040 | AACTGAAATTCCTTGGT | e-e-k-d(10)-k-e-k-e | 67 | 1393 |
| 5001 | 5016 | 530360 | ACTGAAATTCCTTGGT | e-k-d(10)-k-e-k-e | 70 | 1394 |
| 5002 | 5017 | 530108 | AACTGAAATTCCTTGG | e-k-d(10)-k-k-e | 70 | 1395 |
| 5002 | 5017 | 530155 | AACTGAAATTCCTTGG | e-e-k-d(10)-k-k-e | 53 | 1395 |
| 5002 | 5017 | 530205 | AACTGAAATTCCTTGG | e-d-k-d(10)-k-k-e | 44 | 1395 |
| 5002 | 5017 | 530255 | AACTGAAATTCCTTGG | e-d-d-k-d(9)-k-k-e | 33 | 1395 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 5002 | 5017 | 530305 | AACTGAAATTCCTTGG | e-e-e-e-d(9)-k-k-e | 22 | 1395 |
| 5699 | 5714 | 530411 | ACTCTTTCAGTGGTTT | k-d(10)-k-e-k-e-e | 91 | 1396 |
| 5700 | 5716 | 530041 | GTACTCTTTCAGTGGTT | e-e-k-d(10)-k-e-k-e | 89 | 1397 |
| 5700 | 5715 | 530361 | TACTCTTTCAGTGGTT | e-k-d(10)-k-e-k-e | 88 | 1398 |
| 5701 | 5716 | 530109 | GTACTCTTTCAGTGGT | e-k-k-d(10)-k-k-e | 89 | 1399 |
| 5701 | 5716 | 530156 | GTACTCTTTCAGTGGT | e-e-k-d(10)-k-k-e | 91 | 1399 |
| 5701 | 5716 | 530206 | GTACTCTTTCAGTGGT | e-d-k-d(10)-k-k-e | 89 | 1399 |
| 5701 | 5716 | 530256 | GTACTCTTTCAGTGGT | e-d-d-k-d(9)-k-k-e | 33 | 1399 |
| 5701 | 5716 | 530306 | GTACTCTTTCAGTGGT | e-e-e-e-d(9)-k-k-e | 83 | 1399 |
| 5883 | 5898 | 529038 | CTACACTTTACGCTTA | e-e-e-d(10)-k-k-k | 9 | 1400 |
| 6474 | 6489 | 530436 | AATTCATTCTTCCATA | k-d(10)-k-e-k-e-e | 49 | 1401 |
| 6475 | 6491 | 530066 | GAAATTCATTCTTCCAT | e-e-k-d(10)-k-e-k-e | 82 | 1402 |
| 6475 | 6490 | 530386 | AAATTCATTCTTCCAT | e-k-d(10)-k-e-k-e | 53 | 1403 |
| 6476 | 6491 | 530131 | GAAATTCATTCTTCCA | e-k-k-d(10)-k-k-e | 97 | 413 |
| 6476 | 6491 | 530181 | GAAATTCATTCTTCCA | e-e-k-d(10)-k-k-e | 82 | 413 |
| 6476 | 6491 | 530231 | GAAATTCATTCTTCCA | e-d-k-d(10)-k-k-e | 75 | 413 |
| 6476 | 6491 | 530281 | GAAATTCATTCTTCCA | e-d-d-k-d(9)-k-k-e | 69 | 413 |
| 6476 | 6491 | 530331 | GAAATTCATTCTTCCA | e-e-e-e-d(9)-k-k-e | 53 | 413 |
| 6846 | 6861 | 529039 | TTAAAGAGTTGCGGTA | e-e-e-d(10)-k-k-k | 31 | 1404 |
| 6847 | 6862 | 529040 | ATTAAAGAGTTGCGGT | e-e-e-d(10)-k-k-k | 34 | 1405 |
| 8078 | 8093 | 530412 | AGATTTACCTTCCTTA | k-d(10)-k-e-k-e-e | 50 | 1406 |
| 8079 | 8095 | 530042 | GCAGATTTACCTTCCTT | e-e-k-d(10)-k-e-k-e | 78 | 1407 |
| 8079 | 8094 | 530362 | CAGATTTACCTTCCTT | e-k-d(10)-k-e-k-e | 76 | 1408 |
| 8080 | 8095 | 530110 | GCAGATTTACCTTCCT | e-k-k-d(10)-k-k-e | 84 | 1409 |
| 8080 | 8095 | 530157 | GCAGATTTACCTTCCT | e-e-k-d(10)-k-k-e | 69 | 1409 |
| 8080 | 8095 | 530207 | GCAGATTTACCTTCCT | e-d-k-d(10)-k-k-e | 55 | 1409 |
| 8080 | 8095 | 530257 | GCAGATTTACCTTCCT | e-d-d-k-d(9)-k-k-e | 39 | 1409 |
| 8080 | 8095 | 530307 | GCAGATTTACCTTCCT | e-e-e-e-d(9)-k-k-e | 77 | 1409 |
| 9123 | 9138 | 530413 | GCCCCTATGTATAAGC | k-d(10)-k-e-k-e-e | 73 | 1410 |
| 9124 | 9140 | 530043 | CTGCCCCTATGTATAAG | e-e-k-d(10)-k-e-k-e | 42 | 1411 |
| 9124 | 9139 | 530363 | TGCCCCTATGTATAAG | e-k-d(10)-k-e-k-e | 25 | 1412 |
| 9125 | 9140 | 530111 | CTGCCCCTATGTATAA | e-k-k-d(10)-k-k-e | 35 | 1413 |
| 9125 | 9140 | 530158 | CTGCCCCTATGTATAA | e-e-k-d(10)-k-k-e | 36 | 1413 |
| 9125 | 9140 | 530208 | CTGCCCCTATGTATAA | e-d-k-d(10)-k-k-e | 14 | 1413 |
| 9125 | 9140 | 530258 | CTGCCCCTATGTATAA | e-d-d-k-d(9)-k-k-e | 5 | 1413 |
| 9125 | 9140 | 530308 | CTGCCCCTATGTATAA | e-e-e-e-d(9)-k-k-e | 25 | 1413 |
| 9862 | 9877 | 530414 | TTCTTCCTGAGACACA | k-d(10)-k-e-k-e-e | 61 | 1414 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 9863 | 9879 | 530044 | GCTTCTTCCTGAGACAC | e-e-k-d(10)-k-e-k-e | 78 | 1415 |
| 9863 | 9878 | 530364 | CTTCTTCCTGAGACAC | e-k-d(10)-k-e-k-e | 59 | 1416 |
| 9864 | 9879 | 530112 | GCTTCTTCCTGAGACA | e-k-k-d(10)-k-k-e | 84 | 1417 |
| 9864 | 9879 | 530159 | GCTTCTTCCTGAGACA | e-e-k-d(10)-k-k-e | 69 | 1417 |
| 9864 | 9879 | 530209 | GCTTCTTCCTGAGACA | e-d-k-d(10)-k-k-e | 54 | 1417 |
| 9864 | 9879 | 530259 | GCTTCTTCCTGAGACA | e-d-d-k-d(9)-k-k-e | 57 | 1417 |
| 9864 | 9879 | 530309 | GCTTCTTCCTGAGACA | e-e-e-e-d(9)-k-k-e | 46 | 1417 |
| 9864 | 9879 | 530415 | GCTTCTTCCTGAGACA | k-d(10)-k-e-k-e-e | 51 | 1417 |
| 9865 | 9881 | 530045 | TGGCTTCTTCCTGAGAC | e-e-k-d(10)-k-e-k-e | 73 | 1418 |
| 9865 | 9880 | 530365 | GGCTTCTTCCTGAGAC | e-k-d(10)-k-e-k-e | 78 | 1419 |
| 9866 | 9881 | 530113 | TGGCTTCTTCCTGAGA | e-k-k-d(10)-k-k-e | 60 | 1420 |
| 9866 | 9881 | 530160 | TGGCTTCTTCCTGAGA | e-e-k-d(10)-k-k-e | 54 | 1420 |
| 9866 | 9881 | 530210 | TGGCTTCTTCCTGAGA | e-d-k-d(10)-k-k-e | 28 | 1420 |
| 9866 | 9881 | 530260 | TGGCTTCTTCCTGAGA | e-d-d-k-d(9)-k-k-e | 0 | 1420 |
| 9866 | 9881 | 530310 | TGGCTTCTTCCTGAGA | e-e-e-e-d(9)-k-k-e | 26 | 1420 |
| 9873 | 9888 | 530416 | CTCCTGTTGGCTTCTT | k-d(10)-k-e-k-e-e | 57 | 1421 |
| 9874 | 9890 | 530046 | TCCTCCTGTTGGCTTCT | e-e-k-d(10)-k-e-k-e | 76 | 1422 |
| 9874 | 9889 | 530366 | CCTCCTGTTGGCTTCT | e-k-d(10)-k-e-k-e | 75 | 1423 |
| 9874 | 9889 | 530417 | CCTCCTGTTGGCTTCT | k-d(10)-k-e-k-e-e | 66 | 1423 |
| 9875 | 9891 | 530047 | TTCCTCCTGTTGGCTTC | e-e-k-d(10)-k-e-k-e | 75 | 1424 |
| 9875 | 9890 | 530114 | TCCTCCTGTTGGCTTC | e-k-k-d(10)-k-k-e | 80 | 1425 |
| 9875 | 9890 | 530161 | TCCTCCTGTTGGCTTC | e-e-k-d(10)-k-k-e | 81 | 1425 |
| 9875 | 9890 | 530211 | TCCTCCTGTTGGCTTC | e-d-k-d(10)-k-k-e | 73 | 1425 |
| 9875 | 9890 | 530261 | TCCTCCTGTTGGCTTC | e-d-d-k-d(9)-k-k-e | 78 | 1425 |
| 9875 | 9890 | 530311 | TCCTCCTGTTGGCTTC | e-e-e-e-d(9)-k-k-e | 82 | 1425 |
| 9875 | 9890 | 530367 | TCCTCCTGTTGGCTTC | e-k-d(10)-k-e-k-e | 80 | 1425 |
| 9876 | 9891 | 530115 | TTCCTCCTGTTGGCTT | e-k-k-d(10)-k-k-e | 74 | 1426 |
| 9876 | 9891 | 530162 | TTCCTCCTGTTGGCTT | e-e-k-d(10)-k-k-e | 68 | 1426 |
| 9876 | 9891 | 530212 | TTCCTCCTGTTGGCTT | e-d-k-d(10)-k-k-e | 58 | 1426 |
| 9876 | 9891 | 530262 | TTCCTCCTGTTGGCTT | e-d-d-k-d(9)-k-k-e | 23 | 1426 |
| 9876 | 9891 | 530312 | TTCCTCCTGTTGGCTT | e-e-e-e-d(9)-k-k-e | 52 | 1426 |
| 9876 | 9891 | 530418 | TTCCTCCTGTTGGCTT | k-d(10)-k-e-k-e-e | 59 | 1426 |
| 9877 | 9893 | 530048 | GGTTCCTCCTGTTGGCT | e-e-k-d(10)-k-e-k-e | 82 | 1427 |
| 9877 | 9892 | 530368 | GTTCCTCCTGTTGGCT | e-k-d(10)-k-e-k-e | 85 | 1428 |
| 9878 | 9893 | 530116 | GGTTCCTCCTGTTGGC | e-k-k-d(10)-k-k-e | 90 | 1429 |
| 9878 | 9893 | 530163 | GGTTCCTCCTGTTGGC | e-e-k-d(10)-k-k-e | 79 | 1429 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 9878 | 9893 | 530213 | GGTTCCTCCTGTTGGC | e-d-k-d(10)-k-k-e | 72 | 1429 |
| 9878 | 9893 | 530263 | GGTTCCTCCTGTTGGC | e-d-d-k-d(9)-k-k-e | 73 | 1429 |
| 9878 | 9893 | 530313 | GGTTCCTCCTGTTGGC | e-e-e-e-d(9)-k-k-e | 61 | 1429 |
| 9964 | 9979 | 529041 | GTAATGTGCAGCAATC | e-e-e-d(10)-k-k-k | 53 | 1430 |
| 9991 | 10006 | 530711 | ATGTGAGGGCACATTT | e-e-e-d(10)-k-k-k | 25 | 1431 |
| 10286 | 10301 | 529042 | CCAAGCCGTTTATTTC | e-e-e-d(10)-k-k-k | 44 | 1432 |
| 10291 | 10306 | 529043 | GGAAGCCAAGCCGTTT | e-e-e-d(10)-k-k-k | 39 | 1433 |
| 11261 | 11276 | 530413 | GCCCCTATGTATAAGC | k-d(10)-k-e-k-e-e | 73 | 1410 |
| 11262 | 11278 | 530043 | CTGCCCCTATGTATAAG | e-e-k-d(10)-k-e-k-e | 42 | 1411 |
| 11262 | 11277 | 530363 | TGCCCCTATGTATAAG | e-k-d(10)-k-e-k-e | 25 | 1412 |
| 11263 | 11278 | 530111 | CTGCCCCTATGTATAA | e-k-k-d(10)-k-e-k-e | 35 | 1413 |
| 11263 | 11278 | 530158 | CTGCCCCTATGTATAA | e-e-k-d(10)-k-e-k-e | 36 | 1413 |
| 11263 | 11278 | 530208 | CTGCCCCTATGTATAA | e-d-k-d(10)-k-e-k-e | 14 | 1413 |
| 11263 | 11278 | 530258 | CTGCCCCTATGTATAA | e-d-d-k-d(9)-k-k-e | 5 | 1413 |
| 11263 | 11278 | 530308 | CTGCCCCTATGTATAA | e-e-e-e-d(9)-k-k-e | 25 | 1413 |
| 12345 | 12360 | 530414 | TTCTTCCTGAGACACA | k-d(10)-k-e-k-e-e | 61 | 1414 |
| 12346 | 12362 | 530044 | GCTTCTTCCTGAGACAC | e-e-k-d(10)-k-e-k-e | 78 | 1415 |
| 12346 | 12361 | 530364 | CTTCTTCCTGAGACAC | e-k-d(10)-k-e-k-e | 59 | 1416 |
| 12347 | 12362 | 530112 | GCTTCTTCCTGAGACA | e-k-k-d(10)-k-e-k-e | 84 | 1417 |
| 12347 | 12362 | 530159 | GCTTCTTCCTGAGACA | e-e-k-d(10)-k-e-k-e | 69 | 1417 |
| 12347 | 12362 | 530209 | GCTTCTTCCTGAGACA | e-d-k-d(10)-k-e-k-e | 54 | 1417 |
| 12347 | 12362 | 530259 | GCTTCTTCCTGAGACA | e-d-d-k-d(9)-k-k-e | 57 | 1417 |
| 12347 | 12362 | 530309 | GCTTCTTCCTGAGACA | e-e-e-e-d(9)-k-k-e | 46 | 1417 |
| 12347 | 12362 | 530415 | GCTTCTTCCTGAGACA | k-d(10)-k-e-k-e-e | 51 | 1417 |
| 12348 | 12364 | 530045 | TGGCTTCTTCCTGAGAC | e-e-k-d(10)-k-e-k-e | 73 | 1418 |
| 12348 | 12363 | 530365 | GGCTTCTTCCTGAGAC | e-k-d(10)-k-e-k-e | 78 | 1419 |
| 12349 | 12364 | 530113 | TGGCTTCTTCCTGAGA | e-k-k-d(10)-k-e-k-e | 60 | 1420 |
| 12349 | 12364 | 530160 | TGGCTTCTTCCTGAGA | e-e-k-d(10)-k-e-k-e | 54 | 1420 |
| 12349 | 12364 | 530210 | TGGCTTCTTCCTGAGA | e-d-k-d(10)-k-e-k-e | 28 | 1420 |
| 12349 | 12364 | 530260 | TGGCTTCTTCCTGAGA | e-d-d-k-d(9)-k-k-e | 0 | 1420 |
| 12349 | 12364 | 530310 | TGGCTTCTTCCTGAGA | e-e-e-e-d(9)-k-k-e | 26 | 1420 |
| 12356 | 12371 | 530416 | CTCCTGTTGGCTTCTT | k-d(10)-k-e-k-e-e | 57 | 1421 |
| 12357 | 12373 | 530046 | TCCTCCTGTTGGCTTCT | e-e-k-d(10)-k-e-k-e | 76 | 1422 |
| 12357 | 12372 | 530366 | CCTCCTGTTGGCTTCT | e-k-d(10)-k-e-k-e | 75 | 1423 |
| 12357 | 12372 | 530417 | CCTCCTGTTGGCTTCT | k-d(10)-k-e-k-e-e | 66 | 1423 |
| 12358 | 12374 | 530047 | TTCCTCCTGTTGGCTTC | e-e-k-d(10)-k-e-k-e | 75 | 1424 |
| 12358 | 12373 | 530114 | TCCTCCTGTTGGCTTC | e-k-k-d(10)-k-e-k-e | 80 | 1425 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 12358 | 12373 | 530161 | TCCTCCTGTTGGCTTC | e-e-k-d(10)-k-k-e | 81 | 1425 |
| 12358 | 12373 | 530211 | TCCTCCTGTTGGCTTC | e-d-k-d(10)-k-k-e | 73 | 1425 |
| 12358 | 12373 | 530261 | TCCTCCTGTTGGCTTC | e-d-d-k-d(9)-k-k-e | 78 | 1425 |
| 12358 | 12373 | 530311 | TCCTCCTGTTGGCTTC | e-e-e-d(9)-k-k-e | 82 | 1425 |
| 12358 | 12373 | 530367 | TCCTCCTGTTGGCTTC | e-k-d(10)-k-e-k-e | 80 | 1425 |
| 12359 | 12374 | 530115 | TTCCTCCTGTTGGCTT | e-k-k-d(10)-k-k-e | 74 | 1426 |
| 12359 | 12374 | 530162 | TTCCTCCTGTTGGCTT | e-e-k-d(10)-k-k-e | 68 | 1426 |
| 12359 | 12374 | 530212 | TTCCTCCTGTTGGCTT | e-d-k-d(10)-k-k-e | 58 | 1426 |
| 12359 | 12374 | 530262 | TTCCTCCTGTTGGCTT | e-d-d-k-d(9)-k-k-e | 23 | 1426 |
| 12359 | 12374 | 530312 | TTCCTCCTGTTGGCTT | e-e-e-d(9)-k-k-e | 52 | 1426 |
| 12359 | 12374 | 530418 | TTCCTCCTGTTGGCTT | k-d(10)-k-e-k-e-e | 59 | 1426 |
| 12360 | 12376 | 530048 | GGTTCCTCCTGTTGGCT | e-e-k-d(10)-k-e-k-e | 82 | 1427 |
| 12360 | 12375 | 530368 | GTTCCTCCTGTTGGCT | e-k-d(10)-k-e-k-e | 85 | 1428 |
| 12361 | 12376 | 530116 | GGTTCCTCCTGTTGGC | e-k-k-d(10)-k-k-e | 90 | 1429 |
| 12361 | 12376 | 530163 | GGTTCCTCCTGTTGGC | e-e-k-d(10)-k-k-e | 79 | 1429 |
| 12361 | 12376 | 530213 | GGTTCCTCCTGTTGGC | e-d-k-d(10)-k-k-e | 72 | 1429 |
| 12361 | 12376 | 530263 | GGTTCCTCCTGTTGGC | e-d-d-k-d(9)-k-k-e | 73 | 1429 |
| 12361 | 12376 | 530313 | GGTTCCTCCTGTTGGC | e-e-e-d(9)-k-k-e | 61 | 1429 |
| 12586 | 12601 | 530710 | TACAATTCCTGCCTGT | e-e-e-d(10)-k-k-k | 18 | 1434 |
| 15467 | 15482 | 530437 | AGCTTTTCTATGAAAA | k-d(10)-k-e-k-e-e | 5 | 1435 |
| 15468 | 15484 | 530067 | CAAGCTTTTCTATGAAA | e-e-k-d(10)-k-e-k-e | 53 | 1436 |
| 15468 | 15483 | 530387 | AAGCTTTTCTATGAAA | e-k-d(10)-k-e-k-e | 24 | 1437 |
| 15469 | 15484 | 530132 | CAAGCTTTTCTATGAA | e-k-k-d(10)-k-k-e | 74 | 423 |
| 15469 | 15484 | 530182 | CAAGCTTTTCTATGAA | e-e-k-d(10)-k-k-e | 48 | 423 |
| 15469 | 15484 | 530232 | CAAGCTTTTCTATGAA | e-d-k-d(10)-k-k-e | 21 | 423 |
| 15469 | 15484 | 530282 | CAAGCTTTTCTATGAA | e-d-d-k-d(9)-k-k-e | 19 | 423 |
| 15469 | 15484 | 530332 | CAAGCTTTTCTATGAA | e-e-e-d(9)-k-k-e | 20 | 423 |
| 16863 | 16878 | 530419 | TAATTGTGTACTGGCA | k-d(10)-k-e-k-e-e | 75 | 1438 |
| 16864 | 16880 | 530049 | TATAATTGTGTACTGGC | e-e-k-d(10)-k-e-k-e | 88 | 1439 |
| 16864 | 16879 | 530369 | ATAATTGTGTACTGGC | e-k-d(10)-k-e-k-e | 92 | 1440 |
| 16865 | 16880 | 530117 | TATAATTGTGTACTGG | e-k-k-d(10)-k-k-e | 73 | 1441 |
| 16865 | 16880 | 530164 | TATAATTGTGTACTGG | e-e-k-d(10)-k-k-e | 65 | 1441 |
| 16865 | 16880 | 530214 | TATAATTGTGTACTGG | e-d-k-d(10)-k-k-e | 37 | 1441 |
| 16865 | 16880 | 530264 | TATAATTGTGTACTGG | e-d-d-k-d(9)-k-k-e | 48 | 1441 |
| 16865 | 16880 | 530314 | TATAATTGTGTACTGG | e-e-e-d(9)-k-k-e | 42 | 1441 |
| 17385 | 17400 | 530709 | TGGAGTAACAGGAACT | e-e-e-d(10)-k-k-k | 25 | 1442 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 21456 | 21471 | 530720 | AAAGTTTCCCAATAGA | e-e-e-d(10)-k-k-k | 17 | 1443 |
| 22061 | 22076 | 529044 | AGTCCTACCACGGCCC | e-e-e-d(10)-k-k-k | 27 | 1444 |
| 24514 | 24529 | 529045 | TGACGATGCTTGGATA | e-e-e-d(10)-k-k-k | 37 | 1445 |
| 24515 | 24530 | 529046 | CTGACGATGCTTGGAT | e-e-e-d(10)-k-k-k | 8 | 1446 |
| 24579 | 24594 | 529047 | TCACTTTCCCTATACG | e-e-e-d(10)-k-k-k | 18 | 1447 |
| 25105 | 25120 | 530717 | GTAGGTTGAGCAAGCA | e-e-e-d(10)-k-k-k | 77 | 1448 |
| 26061 | 26076 | 530420 | ACTTTAGCCCCTTCCA | k-d(10)-k-e-k-e-e | 44 | 1449 |
| 26062 | 26078 | 530050 | CAACTTTAGCCCCTTCC | e-e-k-d(10)-k-e-k-e | 64 | 1450 |
| 26062 | 26077 | 530370 | AACTTTAGCCCCTTCC | e-k-d(10)-k-e-k-e | 55 | 1451 |
| 26063 | 26078 | 530118 | CAACTTTAGCCCCTTC | e-k-k-d(10)-k-e-k-e | 58 | 1452 |
| 26063 | 26078 | 530165 | CAACTTTAGCCCCTTC | e-k-d(10)-k-e-k-e | 38 | 1452 |
| 26063 | 26078 | 530215 | CAACTTTAGCCCCTTC | e-d-k-d(10)-k-e-k-e | 29 | 1452 |
| 26063 | 26078 | 530265 | CAACTTTAGCCCCTTC | e-d-d-k-d(9)-k-k-e | 3 | 1452 |
| 26063 | 26078 | 530315 | CAACTTTAGCCCCTTC | e-e-e-d(9)-k-k-e | 30 | 1452 |
| 26767 | 26782 | 529048 | AATTCATCGAGCTAAT | e-e-e-d(10)-k-k-k | 0 | 1453 |
| 37758 | 37773 | 529049 | TGCCCCAATTAGGCCA | e-e-e-d(10)-k-k-k | 32 | 1454 |
| 37759 | 37774 | 529050 | TTGCCCCAATTAGGCC | e-e-e-d(10)-k-k-k | 21 | 1455 |
| 41484 | 41499 | 530714 | CCCTGTGGCTCCTTCC | e-e-e-d(10)-k-k-k | 27 | 1456 |
| 41760 | 41775 | 529051 | TACTGTCCTCGAGACA | e-e-e-d(10)-k-k-k | 2 | 1457 |
| 42754 | 42769 | 530719 | AGGAAAAGGAAGAATG | e-e-e-d(10)-k-k-k | 2 | 1458 |
| 42766 | 42781 | 529052 | CGCATATGCCCTAGGA | e-e-e-d(10)-k-k-k | 7 | 1459 |
| 42768 | 42783 | 529053 | GCCGCATATGCCCTAG | e-e-e-d(10)-k-k-k | 41 | 1460 |
| 42769 | 42784 | 529054 | GGCCGCATATGCCCTA | e-e-e-d(10)-k-k-k | 51 | 1461 |
| 43072 | 43087 | 529055 | CGGGTAAGTATACAGA | e-e-e-d(10)-k-k-k | 18 | 1462 |
| 43074 | 43089 | 529056 | CACGGGTAAGTATACA | e-e-e-d(10)-k-k-k | 4 | 1463 |
| 43075 | 43090 | 529057 | TCACGGGTAAGTATAC | e-e-e-d(10)-k-k-k | 5 | 1464 |
| 43077 | 43092 | 529058 | GCTCACGGGTAAGTAT | e-e-e-d(10)-k-k-k | 15 | 1465 |
| 45633 | 45648 | 529059 | GTATACAATGGCCTTT | e-e-e-d(10)-k-k-k | 59 | 1466 |
| 46633 | 46648 | 529060 | CGACCCAATCAGATGC | e-e-e-d(10)-k-k-k | 34 | 1467 |
| 47430 | 47445 | 530708 | GGATAAAATACAAAGG | e-e-e-d(10)-k-k-k | 14 | 1468 |
| 47617 | 47632 | 529061 | GTTCCGAAAAAACCTC | e-e-e-d(10)-k-k-k | 59 | 1469 |
| 47619 | 47634 | 529062 | GGGTTCCGAAAAAACC | e-e-e-d(10)-k-k-k | 16 | 1470 |
| 47752 | 47767 | 530712 | TGCAAACTTTTTCTCT | e-e-e-d(10)-k-k-k | 21 | 1471 |
| 48092 | 48107 | 529063 | ACCCGCTATCCACTCA | e-e-e-d(10)-k-k-k | 20 | 1472 |
| 48402 | 48417 | 530421 | CACTTTCCATTCTAGT | k-d(10)-k-e-k-e-e | 20 | 1473 |
| 48403 | 48419 | 530051 | CACACTTTCCATTCTAG | e-e-k-d(10)-k-e-k-e | 48 | 1474 |
| 48403 | 48418 | 530371 | ACACTTTCCATTCTAG | e-k-d(10)-k-e-k-e | 36 | 1475 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 48404 | 48419 | 530119 | CACACTTTCCATTCTA | e-k-k-d(10)-k-k-e | 47 | 1476 |
| 48404 | 48419 | 530166 | CACACTTTCCATTCTA | e-e-k-d(10)-k-k-e | 53 | 1476 |
| 48404 | 48419 | 530216 | CACACTTTCCATTCTA | e-d-k-d(10)-k-k-e | 34 | 1476 |
| 48404 | 48419 | 530266 | CACACTTTCCATTCTA | e-d-d-k-d(9)-k-k-e | 31 | 1476 |
| 48404 | 48419 | 530316 | CACACTTTCCATTCTA | e-e-e-e-d(9)-k-k-e | 34 | 1476 |
| 48429 | 48444 | 529064 | AGCCCCTATGGTTACC | e-e-e-d(10)-k-k-k | 32 | 1477 |
| 48567 | 48582 | 529065 | GTCTAGAGGCCTATCC | e-e-e-d(10)-k-k-k | 14 | 1478 |
| 48568 | 48583 | 529066 | GGTCTAGAGGCCTATC | e-e-e-d(10)-k-k-k | 17 | 1479 |
| 49762 | 49777 | 530718 | AGATGTTGGATGTCTA | e-e-e-d(10)-k-k-k | 46 | 1480 |
| 50692 | 50707 | 530423 | AGATTCTCTACCACTT | k-d(10)-k-e-k-e-e | 70 | 1054 |
| 50693 | 50709 | 530053 | GGAGATTCTCTACCACT | e-e-k-d(10)-k-e-k-e | 84 | 1055 |
| 50693 | 50708 | 530373 | GAGATTCTCTACCACT | e-k-d(10)-k-e-k-e | 85 | 1056 |
| 50694 | 50709 | 530121 | GGAGATTCTCTACCAC | e-k-k-d(10)-k-k-e | 77 | 53 |
| 50694 | 50709 | 530168 | GGAGATTCTCTACCAC | e-e-k-d(10)-k-k-e | 75 | 53 |
| 50694 | 50709 | 530218 | GGAGATTCTCTACCAC | e-d-k-d(10)-k-k-e | 61 | 53 |
| 50694 | 50709 | 530268 | GGAGATTCTCTACCAC | e-d-d-k-d(9)-k-k-e | 76 | 53 |
| 50694 | 50709 | 530318 | GGAGATTCTCTACCAC | e-e-e-e-d(9)-k-k-e | 73 | 53 |
| 50838 | 50853 | 529067 | CCGCCTTAAGATCTAA | e-e-e-d(10)-k-k-k | 5 | 1481 |
| 51714 | 51729 | 529068 | CCCTTACTCTCCGCAT | e-e-e-d(10)-k-k-k | 15 | 1482 |
| 51734 | 51749 | 529069 | GGGAAGTGGTCCGACC | e-e-e-d(10)-k-k-k | 22 | 1483 |
| 51757 | 51772 | 529070 | CCGCAAGTGAGCGAGA | e-e-e-d(10)-k-k-k | 6 | 1484 |
| 51760 | 51775 | 529071 | ATCCCGCAAGTGAGCG | e-e-e-d(10)-k-k-k | 11 | 1485 |
| 51763 | 51778 | 529072 | GAAATCCCGCAAGTGA | e-e-e-d(10)-k-k-k | 0 | 1486 |
| 51905 | 51920 | 528400 | CCGCCAGCTCACTCAC | e-e-e-d(10)-k-k-k | 57 | 66 |
| 51906 | 51921 | 528401 | CCCGCCAGCTCACTCA | e-e-e-d(10)-k-k-k | 57 | 1059 |
| 51907 | 51922 | 528402 | CCCCGCCAGCTCACTC | e-e-e-d(10)-k-k-k | 42 | 1060 |
| 51910 | 51925 | 528403 | AAGCCCCGCCAGCTCA | e-e-e-d(10)-k-k-k | 72 | 1060 |
| 51911 | 51926 | 528404 | AAAGCCCCGCCAGCTC | e-e-e-d(10)-k-k-k | 52 | 1062 |
| 51912 | 51927 | 528405 | AAAAGCCCCGCCAGCT | e-e-e-d(10)-k-k-k | 27 | 1063 |
| 51913 | 51928 | 528406 | CAAAAGCCCCGCCAGC | e-e-e-d(10)-k-k-k | 29 | 1064 |
| 51914 | 51929 | 528407 | ACAAAAGCCCCGCCAG | e-e-e-d(10)-k-k-k | 9 | 1065 |
| 51916 | 51931 | 528408 | TGACAAAAGCCCCGCC | e-e-e-d(10)-k-k-k | 10 | 1066 |
| 51917 | 51932 | 528409 | CTGACAAAAGCCCCGC | e-e-e-d(10)-k-k-k | 31 | 1067 |
| 51918 | 51933 | 528410 | GCTGACAAAAGCCCCG | e-e-e-d(10)-k-k-k | 39 | 1068 |
| 51919 | 51934 | 528411 | CGCTGACAAAAGCCCC | e-e-e-d(10)-k-k-k | 49 | 1069 |
| 51920 | 51935 | 528412 | TCGCTGACAAAAGCCC | e-e-e-d(10)-k-k-k | 39 | 1070 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 51921 | 51936 | 528413 | ATCGCTGACAAAAGCC | e-e-e-d(10)-k-k-k | 20 | 1071 |
| 51922 | 51937 | 528414 | CATCGCTGACAAAAGC | e-e-e-d(10)-k-k-k | 10 | 1072 |
| 51924 | 51939 | 528415 | TCCATCGCTGACAAAA | e-e-e-d(10)-k-k-k | 11 | 1073 |
| 51925 | 51940 | 528416 | CTCCATCGCTGACAAA | e-e-e-d(10)-k-k-k | 15 | 1074 |
| 51926 | 51941 | 528417 | ACTCCATCGCTGACAA | e-e-e-d(10)-k-k-k | 22 | 1075 |
| 51927 | 51942 | 528418 | TACTCCATCGCTGACA | e-e-e-d(10)-k-k-k | 19 | 1076 |
| 51928 | 51943 | 528419 | GTACTCCATCGCTGAC | e-e-e-d(10)-k-k-k | 37 | 1077 |
| 51929 | 51944 | 528420 | CGTACTCCATCGCTGA | e-e-e-d(10)-k-k-k | 35 | 1078 |
| 51943 | 51958 | 528421 | GAGAGTTTTCTGCACG | e-e-e-d(10)-k-k-k | 36 | 1079 |
| 51945 | 51960 | 528422 | GTGAGAGTTTTCTGCA | e-e-e-d(10)-k-k-k | 22 | 1080 |
| 51964 | 51979 | 528423 | GTCAGCCAGCTCCTCG | e-e-e-d(10)-k-k-k | 49 | 1081 |
| 51975 | 51990 | 528424 | CGCCTCTTCCAGTCAG | e-e-e-d(10)-k-k-k | 42 | 1082 |
| 51977 | 51992 | 528425 | GCCGCCTCTTCCAGTC | e-e-e-d(10)-k-k-k | 44 | 1083 |
| 51978 | 51993 | 528426 | TGCCGCCTCTTCCAGT | e-e-e-d(10)-k-k-k | 15 | 1084 |
| 51983 | 51998 | 528427 | TCTGTTGCCGCCTCTT | e-e-e-d(10)-k-k-k | 9 | 1085 |
| 51984 | 51999 | 528428 | ATCTGTTGCCGCCTCT | e-e-e-d(10)-k-k-k | 30 | 1086 |
| 51985 | 52000 | 528429 | AATCTGTTGCCGCCTC | e-e-e-d(10)-k-k-k | 23 | 1087 |
| 51986 | 52001 | 528430 | CAATCTGTTGCCGCCT | e-e-e-d(10)-k-k-k | 12 | 1088 |
| 51987 | 52002 | 528431 | GCAATCTGTTGCCGCC | e-e-e-d(10)-k-k-k | 48 | 1089 |
| 51988 | 52003 | 528432 | GGCAATCTGTTGCCGC | e-e-e-d(10)-k-k-k | 18 | 1090 |
| 51989 | 52004 | 528433 | AGGCAATCTGTTGCCG | e-e-e-d(10)-k-k-k | 0 | 1091 |
| 51990 | 52005 | 528434 | CAGGCAATCTGTTGCC | e-e-e-d(10)-k-k-k | 8 | 1092 |
| 51991 | 52006 | 528435 | GCAGGCAATCTGTTGC | e-e-e-d(10)-k-k-k | 13 | 1093 |
| 51995 | 52010 | 528436 | CAATGCAGGCAATCTG | e-e-e-d(10)-k-k-k | 9 | 1094 |
| 51996 | 52011 | 528437 | CCAATGCAGGCAATCT | e-e-e-d(10)-k-k-k | 26 | 1095 |
| 51997 | 52012 | 528438 | TCCAATGCAGGCAATC | e-e-e-d(10)-k-k-k | 10 | 1096 |
| 51998 | 52013 | 528439 | CTCCAATGCAGGCAAT | e-e-e-d(10)-k-k-k | 2 | 1097 |
| 51999 | 52014 | 528440 | CCTCCAATGCAGGCAA | e-e-e-d(10)-k-k-k | 28 | 1098 |
| 52016 | 52031 | 528441 | GGCAGATGTTGGGCGG | e-e-e-d(10)-k-k-k | 8 | 1099 |
| 52017 | 52032 | 528442 | AGGCAGATGTTGGGCG | e-e-e-d(10)-k-k-k | 0 | 1100 |
| 52018 | 52033 | 528443 | TAGGCAGATGTTGGGC | e-e-e-d(10)-k-k-k | 1 | 1101 |
| 52019 | 52034 | 528444 | CTAGGCAGATGTTGGG | e-e-e-d(10)-k-k-k | 0 | 1102 |
| 52020 | 52035 | 528445 | TCTAGGCAGATGTTGG | e-e-e-d(10)-k-k-k | 7 | 1103 |
| 52021 | 52036 | 528446 | ATCTAGGCAGATGTTG | e-e-e-d(10)-k-k-k | 3 | 1104 |
| 52023 | 52038 | 528447 | CGATCTAGGCAGATGT | e-e-e-d(10)-k-k-k | 9 | 72 |
| 52024 | 52039 | 528448 | CCGATCTAGGCAGATG | e-e-e-d(10)-k-k-k | 13 | 1105 |
| 52026 | 52041 | 528449 | AGCCGATCTAGGCAGA | e-e-e-d(10)-k-k-k | 4 | 1106 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 52027 | 52042 | 528450 | TAGCCGATCTAGGCAG | e-e-e-d(10)-k-k-k | 11 | 1107 |
| 52028 | 52043 | 528451 | CTAGCCGATCTAGGCA | e-e-e-d(10)-k-k-k | 5 | 1108 |
| 52029 | 52044 | 528452 | TCTAGCCGATCTAGGC | e-e-e-d(10)-k-k-k | 5 | 1109 |
| 52030 | 52045 | 528453 | TTCTAGCCGATCTAGG | e-e-e-d(10)-k-k-k | 24 | 1110 |
| 52031 | 52046 | 528454 | TTTCTAGCCGATCTAG | e-e-e-d(10)-k-k-k | 29 | 1111 |
| 52032 | 52047 | 528455 | TTTTCTAGCCGATCTA | e-e-e-d(10)-k-k-k | 28 | 1112 |
| 52033 | 52048 | 528456 | GTTTTCTAGCCGATCT | e-e-e-d(10)-k-k-k | 42 | 1113 |
| 52035 | 52050 | 528457 | CAGTTTTCTAGCCGAT | e-e-e-d(10)-k-k-k | 50 | 1114 |
| 52036 | 52051 | 528458 | CCAGTTTTCTAGCCGA | e-e-e-d(10)-k-k-k | 70 | 1115 |
| 52083 | 52098 | 529073 | TCAATCTAGCTTTCGA | e-e-e-d(10)-k-k-k | 33 | 1487 |
| 52084 | 52099 | 529074 | TTCAATCTAGCTTTCG | e-e-e-d(10)-k-k-k | 36 | 1488 |
| 52119 | 52134 | 529075 | GTACCAATTCTGTGGG | e-e-e-d(10)-k-k-k | 33 | 1489 |
| 55441 | 55456 | 528462 | GATTCTGCTAATGACG | e-e-e-d(10)-k-k-k | 42 | 1119 |
| 55442 | 55457 | 528463 | AGATTCTGCTAATGAC | e-e-e-d(10)-k-k-k | 38 | 1120 |
| 55446 | 55461 | 528464 | GTTGAGATTCTGCTAA | e-e-e-d(10)-k-k-k | 30 | 1121 |
| 55447 | 55462 | 528465 | AGTTGAGATTCTGCTA | e-e-e-d(10)-k-k-k | 48 | 1122 |
| 55454 | 55469 | 528466 | GGTCTGAAGTTGAGAT | e-e-e-d(10)-k-k-k | 27 | 1123 |
| 55456 | 55471 | 528467 | CGGGTCTGAAGTTGAG | e-e-e-d(10)-k-k-k | 44 | 1124 |
| 55457 | 55472 | 528468 | ACGGGTCTGAAGTTGA | e-e-e-d(10)-k-k-k | 41 | 1125 |
| 55458 | 55473 | 528469 | GACGGGTCTGAAGTTG | e-e-e-d(10)-k-k-k | 45 | 1126 |
| 55459 | 55474 | 528470 | TGACGGGTCTGAAGTT | e-e-e-d(10)-k-k-k | 34 | 1127 |
| 55460 | 55475 | 528471 | TTGACGGGTCTGAAGT | e-e-e-d(10)-k-k-k | 19 | 1128 |
| 55461 | 55476 | 528472 | GTTGACGGGTCTGAAG | e-e-e-d(10)-k-k-k | 21 | 1129 |
| 55462 | 55477 | 528473 | TGTTGACGGGTCTGAA | e-e-e-d(10)-k-k-k | 37 | 1130 |
| 55463 | 55478 | 528474 | TTGTTGACGGGTCTGA | e-e-e-d(10)-k-k-k | 55 | 1131 |
| 55464 | 55479 | 528475 | TTTGTTGACGGGTCTG | e-e-e-d(10)-k-k-k | 63 | 1132 |
| 55465 | 55480 | 528476 | ATTTGTTGACGGGTCT | e-e-e-d(10)-k-k-k | 65 | 1133 |
| 56208 | 56223 | 529076 | GTAACACCTCACCCTA | e-e-e-d(10)-k-k-k | 14 | 1490 |
| 58396 | 58411 | 530715 | TCTGCCACCCAGGTTT | e-e-e-d(10)-k-k-k | 31 | 1491 |
| 59836 | 59851 | 529077 | TAAATTTCCGGGATCT | e-e-e-d(10)-k-k-k | 13 | 1492 |
| 64187 | 64202 | 529078 | CCGGTCCCTTGTAAAA | e-e-e-d(10)-k-k-k | 12 | 1493 |
| 64289 | 64304 | 529079 | GCCAACTCTAGGCGAG | e-e-e-d(10)-k-k-k | 16 | 1494 |
| 64551 | 64566 | 529080 | CGCAAGAGATCCCGGG | e-e-e-d(10)-k-k-k | 0 | 1495 |
| 64552 | 64567 | 529081 | TCGCAAGAGATCCCGG | e-e-e-d(10)-k-k-k | 16 | 1496 |
| 64959 | 64974 | 529082 | TGATCACCTCGACTGA | e-e-e-d(10)-k-k-k | 20 | 1497 |
| 66136 | 66151 | 530425 | GCCCTTGCCAGCCATG | k-d(10)-k-e-k-e-e | 73 | 1134 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 66137 | 66153 | 530054 | AAGCCCTTGCCAGCCAT | e-e-k-d(10)-k-e-k-e | 75 | 1135 |
| 66137 | 66152 | 530375 | AGCCCTTGCCAGCCAT | e-k-d(10)-k-e-k-e | 77 | 1136 |
| 66138 | 66153 | 530123 | AAGCCCTTGCCAGCCA | e-k-k-d(10)-k-k-e | 86 | 144 |
| 66138 | 66153 | 530170 | AAGCCCTTGCCAGCCA | e-e-k-d(10)-k-k-e | 87 | 144 |
| 66138 | 66153 | 530220 | AAGCCCTTGCCAGCCA | e-d-k-d(10)-k-k-e | 74 | 144 |
| 66138 | 66153 | 530270 | AAGCCCTTGCCAGCCA | e-d-d-k-d(9)-k-k-e | 87 | 144 |
| 66138 | 66153 | 530320 | AAGCCCTTGCCAGCCA | e-e-e-e-d(9)-k-k-e | 83 | 144 |
| 66183 | 66198 | 530426 | TTTTTCACAAGGTCAA | k-d(10)-k-e-k-e-e | 55 | 1137 |
| 66184 | 66200 | 530059 | ACTTTTTCACAAGGTCA | e-e-k-d(10)-k-e-k-e | 73 | 1138 |
| 66184 | 66199 | 530376 | CTTTTTCACAAGGTCA | e-k-d(10)-k-e-k-e | 77 | 1139 |
| 66185 | 66200 | 530124 | ACTTTTTCACAAGGTC | e-k-k-d(10)-k-k-e | 79 | 153 |
| 66185 | 66200 | 530171 | ACTTTTTCACAAGGTC | e-e-k-d(10)-k-k-e | 69 | 153 |
| 66185 | 66200 | 530221 | ACTTTTTCACAAGGTC | e-d-k-d(10)-k-k-e | 64 | 153 |
| 66185 | 66200 | 530271 | ACTTTTTCACAAGGTC | e-d-d-k-d(9)-k-k-e | 73 | 153 |
| 66185 | 66200 | 530321 | ACTTTTTCACAAGGTC | e-e-e-e-d(9)-k-k-e | 56 | 153 |
| 66875 | 66890 | 529083 | GCCACCCTAGTGTTGA | e-e-e-d(10)-k-k-k | 27 | 1498 |
| 67066 | 67081 | 530427 | ATGATCTTATAGCCCA | k-d(10)-k-e-k-e-e | 43 | 931 |
| 67067 | 67083 | 530060 | CCATGATCTTATAGCCC | e-e-k-d(10)-k-e-k-e | 77 | 1140 |
| 67067 | 67082 | 530377 | CATGATCTTATAGCCC | e-k-d(10)-k-e-k-e | 66 | 932 |
| 67068 | 67083 | 530125 | CCATGATCTTATAGCC | e-k-k-d(10)-k-k-e | 65 | 175 |
| 67068 | 67083 | 530172 | CCATGATCTTATAGCC | e-e-k-d(10)-k-k-e | 59 | 175 |
| 67068 | 67083 | 530222 | CCATGATCTTATAGCC | e-d-k-d(10)-k-k-e | 48 | 175 |
| 67068 | 67083 | 530272 | CCATGATCTTATAGCC | e-d-d-k-d(9)-k-k-e | 63 | 175 |
| 67068 | 67083 | 530322 | CCATGATCTTATAGCC | e-e-e-e-d(9)-k-k-e | 45 | 175 |
| 67270 | 67285 | 530716 | TTTGCCTATCTATCCT | e-e-e-d(10)-k-k-k | 11 | 1499 |
| 67346 | 67361 | 529084 | CGGTCACCCCAACAAA | e-e-e-d(10)-k-k-k | 33 | 1500 |
| 69470 | 69485 | 529085 | AAGGGCGATGGTAATG | e-e-e-d(10)-k-k-k | 4 | 1501 |
| 71614 | 71629 | 530422 | GTACAATTGCTTCAAC | k-d(10)-k-e-k-e-e | 46 | 1502 |
| 71615 | 71631 | 530052 | CAGTACAATTGCTTCAA | e-e-k-d(10)-k-e-k-e | 51 | 1503 |
| 71615 | 71630 | 530372 | AGTACAATTGCTTCAA | e-k-d(10)-k-e-k-e | 51 | 1504 |
| 71616 | 71631 | 530120 | CAGTACAATTGCTTCA | e-k-k-d(10)-k-k-e | 78 | 1505 |
| 71616 | 71631 | 530167 | CAGTACAATTGCTTCA | e-e-k-d(10)-k-k-e | 69 | 1505 |
| 71616 | 71631 | 530217 | CAGTACAATTGCTTCA | e-d-k-d(10)-k-k-e | 47 | 1505 |
| 71616 | 71631 | 530267 | CAGTACAATTGCTTCA | e-d-d-k-d(9)-k-k-e | 64 | 1505 |
| 71616 | 71631 | 530317 | CAGTACAATTGCTTCA | e-e-e-e-d(9)-k-k-e | 60 | 1505 |
| 72138 | 72153 | 530713 | CTCATGCCAAGATTGT | e-e-e-d(10)-k-k-k | 26 | 1506 |
| 72299 | 72314 | 529086 | AAGCCACTTACGGTGT | e-e-e-d(10)-k-k-k | 0 | 1507 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 72874 | 72889 | 529087 | CGTCTATTTCCAGTGT | e-e-e-d(10)-k-k-k | 22 | 1508 |
| 73648 | 73663 | 529088 | ACTAGTTCAGTTGTCC | e-e-e-d(10)-k-k-k | 0 | 1509 |
| 73866 | 73881 | 530428 | TAGCAGAAGTAGGAGA | k-d(10)-k-e-k-e-e | 49 | 1141 |
| 73867 | 73883 | 530061 | GATAGCAGAAGTAGGAG | e-e-k-d(10)-k-e-k-e | 49 | 1142 |
| 73867 | 73882 | 530378 | ATAGCAGAAGTAGGAG | e-k-d(10)-k-e-k-e | 48 | 1143 |
| 73868 | 73883 | 530126 | GATAGCAGAAGTAGGA | e-k-k-d(10)-k-k-e | 70 | 223 |
| 73868 | 73883 | 530173 | GATAGCAGAAGTAGGA | e-e-k-d(10)-k-k-e | 62 | 223 |
| 73868 | 73883 | 530223 | GATAGCAGAAGTAGGA | e-d-k-d(10)-k-k-e | 44 | 223 |
| 73868 | 73883 | 530273 | GATAGCAGAAGTAGGA | e-d-d-k-d(9)-k-k-e | 63 | 223 |
| 73868 | 73883 | 530323 | GATAGCAGAAGTAGGA | e-e-e-d(9)-k-k-e | 37 | 223 |
| 74199 | 74214 | 530513 | TTGGATGTCAGCAAGG | k-d(10)-k-e-k-e-e | 88 | 1047 |
| 74200 | 74215 | 530507 | TTTGGATGTCAGCAAG | e-k-d(10)-k-e-k-e | 86 | 1144 |
| 74200 | 74215 | 530514 | TTTGGATGTCAGCAAG | k-d(10)-k-e-k-e-e | 80 | 1144 |
| 74201 | 74216 | 530430 | ATTTGGATGTCAGCAA | k-d(10)-k-e-k-e-e | 87 | 1145 |
| 74201 | 74216 | 530468 | ATTTGGATGTCAGCAA | e-k-k-d(10)-k-k-e | 81 | 1145 |
| 74201 | 74216 | 530476 | ATTTGGATGTCAGCAA | e-e-k-d(10)-k-k-e | 82 | 1145 |
| 74201 | 74216 | 530484 | ATTTGGATGTCAGCAA | e-d-k-d(10)-k-k-e | 74 | 1145 |
| 74201 | 74216 | 530492 | ATTTGGATGTCAGCAA | e-d-d-k-d(9)-k-k-e | 83 | 1145 |
| 74201 | 74216 | 530500 | ATTTGGATGTCAGCAA | e-e-e-d(9)-k-k-e | 56 | 1145 |
| 74201 | 74216 | 530508 | ATTTGGATGTCAGCAA | e-k-d(10)-k-e-k-e | 83 | 1145 |
| 74202 | 74218 | 530062 | CTATTTGGATGTCAGCA | e-e-k-d(10)-k-e-k-e | 94 | 1146 |
| 74202 | 74217 | 530380 | TATTTGGATGTCAGCA | e-k-d(10)-k-e-k-e | 94 | 1147 |
| 74202 | 74217 | 530469 | TATTTGGATGTCAGCA | e-k-k-d(10)-k-k-e | 91 | 1147 |
| 74202 | 74217 | 530477 | TATTTGGATGTCAGCA | e-e-k-d(10)-k-k-e | 87 | 1147 |
| 74202 | 74217 | 530485 | TATTTGGATGTCAGCA | e-d-k-d(10)-k-k-e | 87 | 1147 |
| 74202 | 74217 | 530493 | TATTTGGATGTCAGCA | e-d-d-k-d(9)-k-k-e | 81 | 1147 |
| 74202 | 74217 | 530501 | TATTTGGATGTCAGCA | e-e-e-d(9)-k-k-e | 74 | 1147 |
| 74202 | 74217 | 530515 | TATTTGGATGTCAGCA | k-d(10)-k-e-k-e-e | 87 | 1147 |
| 74203 | 74218 | 481464 | CTATTTGGATGTCAGC | k-k-k-d(10)-k-k-k | 93 | 245 |
| 74203 | 74218 | 518349 | CTATTTGGATGTCAGC | e-e-e-d(10)-k-k-k | 58 | 245 |
| 74203 | 74218 | 519637 | CTATTTGGATGTCAGC | e-k-d(10)-k-e-k-e | 96 | 245 |
| 74203 | 74218 | 530175 | CTATTTGGATGTCAGC | e-e-k-d(10)-k-k-e | 93 | 245 |
| 74203 | 74218 | 530225 | CTATTTGGATGTCAGC | e-d-k-d(10)-k-k-e | 85 | 245 |
| 74203 | 74218 | 530275 | CTATTTGGATGTCAGC | e-d-d-k-d(9)-k-k-e | 91 | 245 |
| 74203 | 74218 | 530325 | CTATTTGGATGTCAGC | e-e-e-d(9)-k-k-e | 91 | 245 |
| 74204 | 74219 | 530470 | TCTATTTGGATGTCAG | e-k-k-d(10)-k-k-e | 91 | 1148 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 74204 | 74219 | 530478 | TCTATTTGGATGTCAG | e-e-k-d(10)-k-k-e | 87 | 1148 |
| 74204 | 74219 | 530486 | TCTATTTGGATGTCAG | e-d-k-d(10)-k-k-e | 84 | 1148 |
| 74204 | 74219 | 530494 | TCTATTTGGATGTCAG | e-d-d-k-d(9)-k-k-e | 60 | 1148 |
| 74204 | 74219 | 530502 | TCTATTTGGATGTCAG | e-e-e-d(9)-k-k-e | 64 | 1148 |
| 74204 | 74219 | 530509 | TCTATTTGGATGTCAG | e-k-d(10)-k-e-k-e | 80 | 1148 |
| 74205 | 74220 | 530471 | TTCTATTTGGATGTCA | e-k-k-d(10)-k-k-e | 83 | 1149 |
| 74205 | 74220 | 530479 | TTCTATTTGGATGTCA | e-e-k-d(10)-k-k-e | 74 | 1149 |
| 74205 | 74220 | 530487 | TTCTATTTGGATGTCA | e-d-k-d(10)-k-k-e | 71 | 1149 |
| 74205 | 74220 | 530495 | TTCTATTTGGATGTCA | e-d-d-k-d(9)-k-k-e | 68 | 1149 |
| 74205 | 74220 | 530503 | TTCTATTTGGATGTCA | e-e-e-d(9)-k-k-e | 53 | 1149 |
| 74646 | 74661 | 530431 | CACCAAGGAGGCTGTT | k-d(10)-k-e-k-e-e | 44 | 1150 |
| 74647 | 74663 | 530055 | AGCACCAAGGAGGCTGT | e-e-k-d(10)-k-e-k-e | 45 | 1151 |
| 74647 | 74662 | 530381 | GCACCAAGGAGGCTGT | e-k-d(10)-k-e-k-e | 74 | 1152 |
| 74648 | 74663 | 530128 | AGCACCAAGGAGGCTG | e-k-k-d(10)-k-k-e | 52 | 257 |
| 74648 | 74663 | 530176 | AGCACCAAGGAGGCTG | e-e-k-d(10)-k-k-e | 66 | 257 |
| 74648 | 74663 | 530226 | AGCACCAAGGAGGCTG | e-d-k-d(10)-k-k-e | 51 | 257 |
| 74648 | 74663 | 530276 | AGCACCAAGGAGGCTG | e-d-d-k-d(9)-k-k-e | 70 | 257 |
| 74648 | 74663 | 530326 | AGCACCAAGGAGGCTG | e-e-e-d(9)-k-k-e | 52 | 257 |
| 74714 | 74729 | 528860 | GGTTTGACCTGAAGCC | e-e-e-d(10)-k-k-k | 58 | 1153 |
| 74715 | 74730 | 528861 | GGGTTTGACCTGAAGC | e-e-e-d(10)-k-k-k | 42 | 1154 |
| 74716 | 74731 | 528862 | AGGGTTTGACCTGAAG | e-e-e-d(10)-k-k-k | 57 | 1155 |
| 74717 | 74732 | 528863 | AAGGGTTTGACCTGAA | e-e-e-d(10)-k-k-k | 43 | 1156 |
| 74718 | 74733 | 528864 | TAAGGGTTTGACCTGA | e-e-e-d(10)-k-k-k | 50 | 1157 |
| 74719 | 74734 | 528865 | TTAAGGGTTTGACCTG | e-e-e-d(10)-k-k-k | 32 | 1158 |
| 74734 | 74749 | 528866 | GCAGCTTCAGATGTCT | e-e-e-d(10)-k-k-k | 60 | 1159 |
| 74735 | 74750 | 528867 | TGCAGCTTCAGATGTC | e-e-e-d(10)-k-k-k | 47 | 1160 |
| 74770 | 74785 | 530388 | CTTAAACCTTCCTATT | k-d(10)-k-e-k-e-e | 14 | 1161 |
| 74771 | 74786 | 530338 | CCTTAAACCTTCCTAT | e-k-d(10)-k-e-k-e | 47 | 1162 |
| 74772 | 74787 | 530086 | TCCTTAAACCTTCCTA | e-e-k-d(10)-k-k-e | 58 | 273 |
| 74772 | 74787 | 530133 | TCCTTAAACCTTCCTA | e-e-k-d(10)-k-k-e | 53 | 273 |
| 74772 | 74787 | 530183 | TCCTTAAACCTTCCTA | e-d-k-d(10)-k-k-e | 52 | 273 |
| 74772 | 74787 | 530233 | TCCTTAAACCTTCCTA | e-d-d-k-d(9)-k-k-e | 29 | 273 |
| 74772 | 74787 | 530283 | TCCTTAAACCTTCCTA | e-e-e-d(9)-k-k-e | 32 | 273 |
| 74777 | 74792 | 528868 | GATTCTCCTTAAACCT | e-e-e-d(10)-k-k-k | 45 | 1163 |
| 74778 | 74793 | 530389 | AGATTCTCCTTAAACC | k-d(10)-k-e-k-e-e | 44 | 1164 |
| 74779 | 74794 | 530339 | TAGATTCTCCTTAAAC | e-k-d(10)-k-e-k-e | 41 | 1165 |
| 74780 | 74795 | 530087 | TTAGATTCTCCTTAAA | e-k-k-d(10)-k-k-e | 43 | 1166 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 74780 | 74795 | 530134 | TTAGATTCTCCTTAAA | e-e-k-d(10)-k-k-e | 28 | 1166 |
| 74780 | 74795 | 530184 | TTAGATTCTCCTTAAA | e-d-k-d(10)-k-k-e | 13 | 1166 |
| 74780 | 74795 | 530234 | TTAGATTCTCCTTAAA | e-d-d-k-d(9)-k-k-e | 15 | 1166 |
| 74780 | 74795 | 530284 | TTAGATTCTCCTTAAA | e-e-e-d(9)-k-k-e | 14 | 1166 |
| 74782 | 74797 | 530390 | GCTTAGATTCTCCTTA | k-d(10)-k-e-k-e-e | 83 | 1167 |
| 74783 | 74798 | 530340 | TGCTTAGATTCTCCTT | e-k-d(10)-k-e-k-e | 89 | 1168 |
| 74784 | 74799 | 528869 | ATGCTTAGATTCTCCT | e-e-e-d(10)-k-k-k | 83 | 1169 |
| 74784 | 74799 | 530088 | ATGCTTAGATTCTCCT | e-k-k-d(10)-k-k-e | 90 | 1169 |
| 74784 | 74799 | 530135 | ATGCTTAGATTCTCCT | e-e-k-d(10)-k-k-e | 91 | 1169 |
| 74784 | 74799 | 530185 | ATGCTTAGATTCTCCT | e-d-k-d(10)-k-k-e | 85 | 1169 |
| 74784 | 74799 | 530235 | ATGCTTAGATTCTCCT | e-d-d-k-d(9)-k-k-e | 28 | 1169 |
| 74784 | 74799 | 530285 | ATGCTTAGATTCTCCT | e-e-e-d(9)-k-k-e | 86 | 1169 |
| 74784 | 74799 | 530391 | ATGCTTAGATTCTCCT | k-d(10)-k-e-k-e-e | 79 | 1169 |
| 74785 | 74801 | 530021 | AAATGCTTAGATTCTCC | e-e-k-d(10)-k-e-k-e | 87 | 1170 |
| 74785 | 74800 | 530341 | AATGCTTAGATTCTCC | e-k-d(10)-k-e-k-e | 88 | 1171 |
| 74786 | 74801 | 530089 | AAATGCTTAGATTCTC | e-k-k-d(10)-k-k-e | 71 | 1172 |
| 74786 | 74801 | 530136 | AAATGCTTAGATTCTC | e-e-k-d(10)-k-k-e | 66 | 1172 |
| 74786 | 74801 | 530186 | AAATGCTTAGATTCTC | e-d-k-d(10)-k-k-e | 51 | 1172 |
| 74786 | 74801 | 530236 | AAATGCTTAGATTCTC | e-d-d-k-d(9)-k-k-e | 74 | 1172 |
| 74786 | 74801 | 530286 | AAATGCTTAGATTCTC | e-e-e-d(9)-k-k-e | 56 | 1172 |
| 74869 | 74884 | 528870 | GTAAGCACCCTCTGCC | e-e-e-d(10)-k-k-k | 26 | 1173 |
| 74871 | 74886 | 528871 | TTGTAAGCACCCTCTG | e-e-e-d(10)-k-k-k | 14 | 1174 |
| 74873 | 74888 | 528872 | GGTTGTAAGCACCCTC | e-e-e-d(10)-k-k-k | 47 | 1175 |
| 74874 | 74889 | 528873 | AGGTTGTAAGCACCCT | e-e-e-d(10)-k-k-k | 40 | 1176 |
| 74875 | 74890 | 528874 | AAGGTTGTAAGCACCC | e-e-e-d(10)-k-k-k | 54 | 1177 |
| 74877 | 74892 | 528875 | TCAAGGTTGTAAGCAC | e-e-e-d(10)-k-k-k | 15 | 1178 |
| 74878 | 74893 | 528876 | GTCAAGGTTGTAAGCA | e-e-e-d(10)-k-k-k | 28 | 1179 |
| 74879 | 74894 | 528877 | AGTCAAGGTTGTAAGC | e-e-e-d(10)-k-k-k | 28 | 1180 |
| 74881 | 74896 | 528878 | GGAGTCAAGGTTGTAA | e-e-e-d(10)-k-k-k | 6 | 1181 |
| 74882 | 74897 | 528879 | GGGAGTCAAGGTTGTA | e-e-e-d(10)-k-k-k | 22 | 1182 |
| 74901 | 74916 | 530392 | GATCAAGTCCAGGGAG | k-d(10)-k-e-k-e-e | 47 | 1183 |
| 74902 | 74918 | 530022 | CAGATCAAGTCCAGGGA | e-e-k-d(10)-k-e-k-e | 80 | 1184 |
| 74902 | 74917 | 530342 | AGATCAAGTCCAGGGA | e-k-d(10)-k-e-k-e | 70 | 1185 |
| 74902 | 74917 | 530393 | AGATCAAGTCCAGGGA | k-d(10)-k-e-k-e-e | 46 | 1185 |
| 74903 | 74919 | 530023 | GCAGATCAAGTCCAGGG | e-e-k-d(10)-k-e-k-e | 74 | 1186 |
| 74903 | 74918 | 530090 | CAGATCAAGTCCAGGG | e-k-k-d(10)-k-k-e | 78 | 1187 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 74903 | 74918 | 530137 | CAGATCAAGTCCAGGG | e-e-k-d(10)-k-k-e | 76 | 1187 |
| 74903 | 74918 | 530187 | CAGATCAAGTCCAGGG | e-d-k-d(10)-k-k-e | 68 | 1187 |
| 74903 | 74918 | 530237 | CAGATCAAGTCCAGGG | e-d-d-k-d(9)-k-k-e | 36 | 1187 |
| 74903 | 74918 | 530287 | CAGATCAAGTCCAGGG | e-e-e-d(9)-k-k-e | 56 | 1187 |
| 74903 | 74918 | 530343 | CAGATCAAGTCCAGGG | e-k-d(10)-k-e-k-e | 68 | 1187 |
| 74903 | 74918 | 530394 | CAGATCAAGTCCAGGG | k-d(10)-k-e-k-e-e | 49 | 1187 |
| 74904 | 74919 | 518343 | GCAGATCAAGTCCAGG | e-e-e-d(10)-k-k-k | 5 | 1188 |
| 74904 | 74920 | 530024 | AGCAGATCAAGTCCAGG | e-e-k-d(10)-k-e-k-e | 79 | 1189 |
| 74904 | 74919 | 530091 | GCAGATCAAGTCCAGG | e-k-k-d(10)-k-k-e | 81 | 1188 |
| 74904 | 74919 | 530138 | GCAGATCAAGTCCAGG | e-e-k-d(10)-k-k-e | 81 | 1188 |
| 74904 | 74919 | 530188 | GCAGATCAAGTCCAGG | e-d-k-d(10)-k-k-e | 78 | 1188 |
| 74904 | 74919 | 530238 | GCAGATCAAGTCCAGG | e-d-d-k-d(9)-k-k-e | 29 | 1188 |
| 74904 | 74919 | 530288 | GCAGATCAAGTCCAGG | e-e-e-d(9)-k-k-e | 69 | 1188 |
| 74904 | 74919 | 530344 | GCAGATCAAGTCCAGG | e-k-d(10)-k-e-k-e | 85 | 1188 |
| 74905 | 74920 | 530092 | AGCAGATCAAGTCCAG | e-k-k-d(10)-k-k-e | 85 | 1190 |
| 74905 | 74920 | 530139 | AGCAGATCAAGTCCAG | e-e-k-d(10)-k-k-e | 79 | 1190 |
| 74905 | 74920 | 530189 | AGCAGATCAAGTCCAG | e-d-k-d(10)-k-k-e | 77 | 1190 |
| 74905 | 74920 | 530239 | AGCAGATCAAGTCCAG | e-d-d-k-d(9)-k-k-e | 61 | 1190 |
| 74905 | 74920 | 530289 | AGCAGATCAAGTCCAG | e-e-e-d(9)-k-k-e | 75 | 1190 |
| 74907 | 74922 | 528880 | ACAGCAGATCAAGTCC | e-e-e-d(10)-k-k-k | 65 | 1191 |
| 74908 | 74923 | 528881 | AACAGCAGATCAAGTC | e-e-e-d(10)-k-k-k | 44 | 1192 |
| 74924 | 74939 | 528882 | ACAACCTAGCCTCTGA | e-e-e-d(10)-k-k-k | 39 | 1193 |
| 74925 | 74940 | 528883 | AACAACCTAGCCTCTG | e-e-e-d(10)-k-k-k | 46 | 1194 |
| 74927 | 74942 | 528884 | GAAACAACCTAGCCTC | e-e-e-d(10)-k-k-k | 37 | 1195 |
| 74928 | 74943 | 528885 | AGAAACAACCTAGCCT | e-e-e-d(10)-k-k-k | 20 | 1196 |
| 74929 | 74944 | 528886 | CAGAAACAACCTAGCC | e-e-e-d(10)-k-k-k | 21 | 1197 |
| 74942 | 74957 | 528887 | GATAAGGCACCCACAG | e-e-e-d(10)-k-k-k | 25 | 1198 |
| 74943 | 74958 | 528888 | TGATAAGGCACCCACA | e-e-e-d(10)-k-k-k | 12 | 1199 |
| 74944 | 74959 | 528889 | CTGATAAGGCACCCAC | e-e-e-d(10)-k-k-k | 25 | 1200 |
| 74946 | 74961 | 528890 | CCCTGATAAGGCACCC | e-e-e-d(10)-k-k-k | 42 | 1201 |
| 74947 | 74962 | 528891 | GCCCTGATAAGGCACC | e-e-e-d(10)-k-k-k | 49 | 1202 |
| 74952 | 74967 | 528892 | TCCCAGCCCTGATAAG | e-e-e-d(10)-k-k-k | 0 | 1203 |
| 74954 | 74969 | 528893 | TATCCCAGCCCTGATA | e-e-e-d(10)-k-k-k | 0 | 1204 |
| 74957 | 74972 | 528894 | AAGTATCCCAGCCCTG | e-e-e-d(10)-k-k-k | 25 | 1205 |
| 74958 | 74973 | 528895 | GAAGTATCCCAGCCCT | e-e-e-d(10)-k-k-k | 39 | 1206 |
| 74959 | 74974 | 528896 | AGAAGTATCCCAGCCC | e-e-e-d(10)-k-k-k | 22 | 1207 |
| 74960 | 74975 | 528897 | CAGAAGTATCCCAGCC | e-e-e-d(10)-k-k-k | 36 | 1208 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 75079 | 75094 | 528898 | TGAGACCAGGATTCCT | e-e-e-d(10)-k-k-k | 41 | 1209 |
| 75083 | 75098 | 528899 | GTCCTGAGACCAGGAT | e-e-e-d(10)-k-k-k | 19 | 1210 |
| 75164 | 75179 | 528900 | AGCTCAACCAGACACG | e-e-e-d(10)-k-k-k | 54 | 311 |
| 75166 | 75181 | 528901 | TGAGCTCAACCAGACA | e-e-e-d(10)-k-k-k | 40 | 1211 |
| 75171 | 75186 | 528902 | TTCCCTGAGCTCAACC | e-e-e-d(10)-k-k-k | 32 | 1212 |
| 75179 | 75194 | 528903 | GAACCATATTCCCTGA | e-e-e-d(10)-k-k-k | 30 | 313 |
| 75182 | 75197 | 528904 | TAAGAACCATATTCCC | e-e-e-d(10)-k-k-k | 27 | 1213 |
| 75209 | 75224 | 518344 | GCCACTGGATATCACC | e-e-e-d(10)-k-k-k | 89 | 317 |
| 75254 | 75269 | 528905 | TAAGCCTTTGCCCTGC | e-e-e-d(10)-k-k-k | 64 | 1214 |
| 75255 | 75270 | 528906 | GTAAGCCTTTGCCCTG | e-e-e-d(10)-k-k-k | 53 | 1215 |
| 75256 | 75271 | 528907 | AGTAAGCCTTTGCCCT | e-e-e-d(10)-k-k-k | 45 | 1216 |
| 75257 | 75272 | 528908 | CAGTAAGCCTTTGCCC | e-e-e-d(10)-k-k-k | 40 | 1217 |
| 75259 | 75274 | 528909 | ATCAGTAAGCCTTTGC | e-e-e-d(10)-k-k-k | 53 | 1218 |
| 75260 | 75275 | 528910 | TATCAGTAAGCCTTTG | e-e-e-d(10)-k-k-k | 47 | 1219 |
| 75264 | 75279 | 528911 | AGTTTATCAGTAAGCC | e-e-e-d(10)-k-k-k | 58 | 1220 |
| 75270 | 75285 | 528912 | GACTCAAGTTTATCAG | e-e-e-d(10)-k-k-k | 37 | 1221 |
| 75272 | 75287 | 528913 | CAGACTCAAGTTTATC | e-e-e-d(10)-k-k-k | 39 | 1222 |
| 75273 | 75288 | 528914 | GCAGACTCAAGTTTAT | e-e-e-d(10)-k-k-k | 0 | 1223 |
| 75274 | 75289 | 528915 | GGCAGACTCAAGTTTA | e-e-e-d(10)-k-k-k | 1 | 1224 |
| 75275 | 75290 | 528916 | GGGCAGACTCAAGTTT | e-e-e-d(10)-k-k-k | 0 | 1225 |
| 75276 | 75291 | 528917 | AGGGCAGACTCAAGTT | e-e-e-d(10)-k-k-k | 9 | 1226 |
| 75278 | 75293 | 528918 | CGAGGGCAGACTCAAG | e-e-e-d(10)-k-k-k | 2 | 1227 |
| 75280 | 75295 | 528919 | TACGAGGGCAGACTCA | e-e-e-d(10)-k-k-k | 20 | 324 |
| 75281 | 75296 | 528920 | ATACGAGGGCAGACTC | e-e-e-d(10)-k-k-k | 14 | 1228 |
| 75282 | 75297 | 528921 | CATACGAGGGCAGACT | e-e-e-d(10)-k-k-k | 0 | 1229 |
| 75283 | 75298 | 528922 | TCATACGAGGGCAGAC | e-e-e-d(10)-k-k-k | 8 | 1230 |
| 75285 | 75300 | 528923 | CCTCATACGAGGGCAG | e-e-e-d(10)-k-k-k | 2 | 1231 |
| 75286 | 75301 | 528924 | CCCTCATACGAGGGCA | e-e-e-d(10)-k-k-k | 2 | 1232 |
| 75287 | 75302 | 528925 | ACCCTCATACGAGGGC | e-e-e-d(10)-k-k-k | 0 | 1233 |
| 75412 | 75427 | 528926 | TACGCACAGGAGAGGC | e-e-e-d(10)-k-k-k | 20 | 1233 |
| 75413 | 75428 | 528927 | ATACGCACAGGAGAGG | e-e-e-d(10)-k-k-k | 0 | 1234 |
| 75414 | 75429 | 528928 | CATACGCACAGGAGAG | e-e-e-d(10)-k-k-k | 6 | 1235 |
| 75415 | 75430 | 528929 | CCATACGCACAGGAGA | e-e-e-d(10)-k-k-k | 4 | 1236 |
| 75416 | 75431 | 528930 | CCCATACGCACAGGAG | e-e-e-d(10)-k-k-k | 36 | 1237 |
| 75417 | 75432 | 528931 | TCCCATACGCACAGGA | e-e-e-d(10)-k-k-k | 22 | 1238 |
| 75418 | 75433 | 528932 | TTCCCATACGCACAGG | e-e-e-d(10)-k-k-k | 32 | 1239 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 75419 | 75434 | 528933 | GTTCCCATACGCACAG | e-e-e-d(10)-k-k-k | 45 | 1240 |
| 75420 | 75435 | 528934 | TGTTCCCATACGCACA | e-e-e-d(10)-k-k-k | 36 | 1241 |
| 75421 | 75436 | 528935 | GTGTTCCCATACGCAC | e-e-e-d(10)-k-k-k | 20 | 1242 |
| 75421 | 75436 | 530395 | GTGTTCCCATACGCAC | k-d(10)-k-e-k-e-e | 71 | 1242 |
| 75422 | 75437 | 528936 | GGTGTTCCCATACGCA | e-e-e-d(10)-k-k-k | 71 | 1243 |
| 75422 | 75438 | 530025 | AGGTGTTCCCATACGCA | e-e-k-d(10)-k-e-k-e | 90 | 1244 |
| 75422 | 75437 | 530345 | GGTGTTCCCATACGCA | e-k-d(10)-k-e-k-e | 93 | 1243 |
| 75422 | 75437 | 530396 | GGTGTTCCCATACGCA | k-d(10)-k-e-k-e-e | 71 | 1243 |
| 75423 | 75438 | 528937 | AGGTGTTCCCATACGC | e-e-e-d(10)-k-k-k | 73 | 1245 |
| 75423 | 75439 | 530026 | TAGGTGTTCCCATACGC | e-e-k-d(10)-k-e-k-e | 87 | 1246 |
| 75423 | 75438 | 530093 | AGGTGTTCCCATACGC | e-k-d(10)-k-e-k-e | 95 | 1245 |
| 75423 | 75438 | 530140 | AGGTGTTCCCATACGC | e-e-k-d(10)-k-e-k-e | 89 | 1245 |
| 75423 | 75438 | 530190 | AGGTGTTCCCATACGC | e-d-k-d(10)-k-k-e | 82 | 1245 |
| 75423 | 75438 | 530240 | AGGTGTTCCCATACGC | e-d-d-k-d(9)-k-k-e | 50 | 1245 |
| 75423 | 75438 | 530290 | AGGTGTTCCCATACGC | e-e-e-e-d(9)-k-k-e | 69 | 1245 |
| 75423 | 75438 | 530346 | AGGTGTTCCCATACGC | e-k-d(10)-k-e-k-e | 89 | 1245 |
| 75424 | 75439 | 528938 | TAGGTGTTCCCATACG | e-e-e-d(10)-k-k-k | 72 | 336 |
| 75424 | 75439 | 530094 | TAGGTGTTCCCATACG | e-k-k-d(10)-k-e-k | 88 | 336 |
| 75424 | 75439 | 530141 | TAGGTGTTCCCATACG | e-e-k-d(10)-k-e-k-e | 80 | 336 |
| 75424 | 75439 | 530191 | TAGGTGTTCCCATACG | e-d-k-d(10)-k-e-k-e | 74 | 336 |
| 75424 | 75439 | 530241 | TAGGTGTTCCCATACG | e-d-d-k-d(9)-k-k-e | 53 | 336 |
| 75424 | 75439 | 530291 | TAGGTGTTCCCATACG | e-e-e-e-d(9)-k-k-e | 68 | 336 |
| 75425 | 75440 | 528939 | CTAGGTGTTCCCATAC | e-e-e-d(10)-k-k-k | 39 | 1247 |
| 75426 | 75441 | 528940 | GCTAGGTGTTCCCATA | e-e-e-d(10)-k-k-k | 62 | 1248 |
| 75427 | 75442 | 528941 | TGCTAGGTGTTCCCAT | e-e-e-d(10)-k-k-k | 49 | 1249 |
| 75429 | 75444 | 528942 | CGTGCTAGGTGTTCCC | e-e-e-d(10)-k-k-k | 77 | 1250 |
| 75491 | 75506 | 528943 | CAAGGTGGTTTTGAGT | e-e-e-d(10)-k-k-k | 25 | 1251 |
| 75492 | 75507 | 528944 | GCAAGGTGGTTTTGAG | e-e-e-d(10)-k-k-k | 28 | 344 |
| 75507 | 75522 | 528945 | CTCTGATCAGCTGAGG | e-e-e-d(10)-k-k-k | 74 | 1252 |
| 75508 | 75523 | 528946 | ACTCTGATCAGCTGAG | e-e-e-d(10)-k-k-k | 56 | 1253 |
| 75549 | 75564 | 528947 | GAGACCAGCTAATTTG | e-e-e-d(10)-k-k-k | 36 | 1254 |
| 75582 | 75597 | 528948 | CATCTTAGAGAAGGTC | e-e-e-d(10)-k-k-k | 59 | 1255 |
| 75622 | 75637 | 528949 | TCAACTGTCTCCAGGC | e-e-e-d(10)-k-k-k | 67 | 1256 |
| 75622 | 75637 | 530397 | TCAACTGTCTCCAGGC | k-d(10)-k-e-k-e-e | 60 | 1256 |
| 75623 | 75638 | 528950 | ATCAACTGTCTCCAGG | e-e-e-d(10)-k-k-k | 57 | 1257 |
| 75623 | 75639 | 530027 | CATCAACTGTCTCCAGG | e-e-k-d(10)-k-e-k-e | 56 | 1258 |
| 75623 | 75638 | 530347 | ATCAACTGTCTCCAGG | e-k-d(10)-k-e-k-e | 49 | 1257 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 75624 | 75639 | 530095 | CATCAACTGTCTCCAG | e-k-k-d(10)-k-k-e | 40 | 354 |
| 75624 | 75639 | 530142 | CATCAACTGTCTCCAG | e-e-k-d(10)-k-k-e | 43 | 354 |
| 75624 | 75639 | 530192 | CATCAACTGTCTCCAG | e-d-k-d(10)-k-k-e | 42 | 354 |
| 75624 | 75639 | 530242 | CATCAACTGTCTCCAG | e-d-d-k-d(9)-k-k-e | 0 | 354 |
| 75624 | 75639 | 530292 | CATCAACTGTCTCCAG | e-e-e-e-d(9)-k-k-e | 36 | 354 |
| 75624 | 75639 | 530398 | CATCAACTGTCTCCAG | k-d(10)-k-e-k-e-e | 28 | 354 |
| 75625 | 75641 | 530028 | CACATCAACTGTCTCCA | e-e-k-d(10)-k-e-k-e | 57 | 1259 |
| 75625 | 75640 | 530348 | ACATCAACTGTCTCCA | e-k-d(10)-k-e-k-e | 58 | 1260 |
| 75626 | 75641 | 530096 | CACATCAACTGTCTCC | e-k-k-d(10)-k-k-e | 72 | 356 |
| 75626 | 75641 | 530143 | CACATCAACTGTCTCC | e-e-k-d(10)-k-k-e | 74 | 356 |
| 75626 | 75641 | 530193 | CACATCAACTGTCTCC | e-d-k-d(10)-k-k-e | 62 | 356 |
| 75626 | 75641 | 530243 | CACATCAACTGTCTCC | e-d-d-k-d(9)-k-k-e | 34 | 356 |
| 75626 | 75641 | 530293 | CACATCAACTGTCTCC | e-e-e-e-d(9)-k-k-e | 59 | 356 |
| 75628 | 75643 | 528951 | GACACATCAACTGTCT | e-e-e-d(10)-k-k-k | 16 | 1261 |
| 75662 | 75677 | 528952 | GAAGAGTGTTGCTGGA | e-e-e-d(10)-k-k-k | 57 | 1262 |
| 75664 | 75679 | 528953 | CTGAAGAGTGTTGCTG | e-e-e-d(10)-k-k-k | 46 | 1263 |
| 75666 | 75681 | 528954 | TACTGAAGAGTGTTGC | e-e-e-d(10)-k-k-k | 42 | 1264 |
| 75672 | 75687 | 530510 | ATTATGTACTGAAGAG | k-d(10)-k-e-k-e-e | 53 | 1265 |
| 75673 | 75688 | 530504 | TATTATGTACTGAAGA | e-k-d(10)-k-e-k-e | 25 | 1266 |
| 75673 | 75688 | 530511 | TATTATGTACTGAAGA | k-d(10)-k-e-k-e-e | 31 | 1266 |
| 75674 | 75689 | 530432 | TTATTATGTACTGAAG | k-d(10)-k-e-k-e-e | 15 | 1267 |
| 75674 | 75689 | 530463 | TTATTATGTACTGAAG | e-k-k-d(10)-k-k-e | 20 | 1267 |
| 75674 | 75689 | 530472 | TTATTATGTACTGAAG | e-e-k-d(10)-k-k-e | 17 | 1267 |
| 75674 | 75689 | 530480 | TTATTATGTACTGAAG | e-d-k-d(10)-k-k-e | 4 | 1267 |
| 75674 | 75689 | 530488 | TTATTATGTACTGAAG | e-d-d-k-d(9)-k-k-e | 13 | 1267 |
| 75674 | 75689 | 530496 | TTATTATGTACTGAAG | e-e-e-e-d(9)-k-k-e | 0 | 1267 |
| 75674 | 75689 | 530505 | TTATTATGTACTGAAG | e-k-d(10)-k-e-k-e | 37 | 1267 |
| 75675 | 75691 | 530063 | GCTTATTATGTACTGAA | e-e-k-d(10)-k-e-k-e | 74 | 1268 |
| 75675 | 75690 | 530382 | CTTATTATGTACTGAA | e-k-d(10)-k-e-k-e | 17 | 1269 |
| 75675 | 75690 | 530465 | CTTATTATGTACTGAA | e-k-k-d(10)-k-k-e | 63 | 1269 |
| 75675 | 75690 | 530473 | CTTATTATGTACTGAA | e-e-k-d(10)-k-k-e | 45 | 1269 |
| 75675 | 75690 | 530481 | CTTATTATGTACTGAA | e-d-k-d(10)-k-k-e | 14 | 1269 |
| 75675 | 75690 | 530489 | CTTATTATGTACTGAA | e-d-d-k-d(9)-k-k-e | 13 | 1269 |
| 75675 | 75690 | 530497 | CTTATTATGTACTGAA | e-e-e-e-d(9)-k-k-e | 7 | 1269 |
| 75675 | 75690 | 530512 | CTTATTATGTACTGAA | k-d(10)-k-e-k-e-e | 21 | 1269 |
| 75676 | 75691 | 519638 | GCTTATTATGTACTGA | e-k-k-d(10)-k-k-e | 86 | 362 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 75676 | 75691 | 530177 | GCTTATTATGTACTGA | e-e-k-d(10)-k-k-e | 71 | 362 |
| 75676 | 75691 | 530227 | GCTTATTATGTACTGA | e-d-k-d(10)-k-k-e | 51 | 362 |
| 75676 | 75691 | 530277 | GCTTATTATGTACTGA | e-d-d-k-d(9)-k-k-e | 70 | 362 |
| 75676 | 75691 | 530327 | GCTTATTATGTACTGA | e-e-e-d(9)-k-k-e | 61 | 362 |
| 75677 | 75692 | 530466 | AGCTTATTATGTACTG | e-k-k-d(10)-k-k-e | 82 | 1270 |
| 75677 | 75692 | 530474 | AGCTTATTATGTACTG | e-e-k-d(10)-k-k-e | 62 | 1270 |
| 75677 | 75692 | 530482 | AGCTTATTATGTACTG | e-d-k-d(10)-k-k-e | 53 | 1270 |
| 75677 | 75692 | 530490 | AGCTTATTATGTACTG | e-d-d-k-d(9)-k-k-e | 42 | 1270 |
| 75677 | 75692 | 530498 | AGCTTATTATGTACTG | e-e-e-d(9)-k-k-e | 45 | 1270 |
| 75677 | 75692 | 530506 | AGCTTATTATGTACTG | e-k-d(10)-k-e-k-e | 70 | 1270 |
| 75678 | 75693 | 530467 | AAGCTTATTATGTACT | e-k-k-d(10)-k-k-e | 50 | 1271 |
| 75678 | 75693 | 530475 | AAGCTTATTATGTACT | e-e-k-d(10)-k-k-e | 26 | 1271 |
| 75678 | 75693 | 530483 | AAGCTTATTATGTACT | e-d-k-d(10)-k-k-e | 19 | 1271 |
| 75678 | 75693 | 530491 | AAGCTTATTATGTACT | e-d-d-k-d(9)-k-k-e | 13 | 1271 |
| 75678 | 75693 | 530499 | AAGCTTATTATGTACT | e-e-e-d(9)-k-k-e | 15 | 1271 |
| 75679 | 75694 | 528955 | TAAGCTTATTATGTAC | e-e-e-d(10)-k-k-k | 0 | 1272 |
| 75686 | 75701 | 528956 | TATCAGTTAAGCTTAT | e-e-e-d(10)-k-k-k | 0 | 1273 |
| 75689 | 75704 | 528957 | GTTTATCAGTTAAGCT | e-e-e-d(10)-k-k-k | 31 | 1274 |
| 75726 | 75741 | 530433 | CAATGGTAAGCCCAAG | k-d(10)-k-e-k-e-e | 62 | 1275 |
| 75727 | 75742 | 528958 | CCAATGGTAAGCCCAA | e-e-e-d(10)-k-k-k | 66 | 1276 |
| 75727 | 75743 | 530056 | CCCAATGGTAAGCCCAA | e-e-k-d(10)-k-e-k-e | 73 | 1277 |
| 75727 | 75742 | 530383 | CCAATGGTAAGCCCAA | e-k-d(10)-k-e-k-e | 64 | 1276 |
| 75728 | 75743 | 518345 | CCCAATGGTAAGCCCA | e-e-e-d(10)-k-k-k | 80 | 366 |
| 75728 | 75743 | 519636 | CCCAATGGTAAGCCCA | e-k-k-d(10)-k-k-e | 90 | 366 |
| 75728 | 75743 | 530178 | CCCAATGGTAAGCCCA | e-e-k-d(10)-k-k-e | 86 | 366 |
| 75728 | 75743 | 530228 | CCCAATGGTAAGCCCA | e-d-k-d(10)-k-k-e | 77 | 366 |
| 75728 | 75743 | 530278 | CCCAATGGTAAGCCCA | e-d-d-k-d(9)-k-k-e | 86 | 366 |
| 75728 | 75743 | 530328 | CCCAATGGTAAGCCCA | e-e-e-d(9)-k-k-e | 80 | 366 |
| 75729 | 75744 | 528959 | ACCCAATGGTAAGCCC | e-e-e-d(10)-k-k-k | 73 | 1277 |
| 75731 | 75746 | 528960 | AAACCCAATGGTAAGC | e-e-e-d(10)-k-k-k | 43 | 1278 |
| 75732 | 75747 | 528961 | TAAACCCAATGGTAAG | e-e-e-d(10)-k-k-k | 18 | 1279 |
| 75733 | 75748 | 528962 | TTAAACCCAATGGTAA | e-e-e-d(10)-k-k-k | 13 | 1280 |
| 75734 | 75749 | 528963 | TTTAAACCCAATGGTA | e-e-e-d(10)-k-k-k | 2 | 1281 |
| 75741 | 75756 | 528964 | CCTATGATTTAAACCC | e-e-e-d(10)-k-k-k | 17 | 1282 |
| 75745 | 75760 | 528965 | GGTCCCTATGATTTAA | e-e-e-d(10)-k-k-k | 31 | 1283 |
| 75746 | 75761 | 528966 | AGGTCCCTATGATTTA | e-e-e-d(10)-k-k-k | 22 | 1284 |
| 75802 | 75817 | 528967 | CCTAAGGCCATGAACT | e-e-e-d(10)-k-k-k | 19 | 374 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 75803 | 75818 | 528968 | ACCTAAGGCCATGAAC | e-e-e-d(10)-k-k-k | 25 | 1285 |
| 75804 | 75819 | 528969 | TACCTAAGGCCATGAA | e-e-e-d(10)-k-k-k | 41 | 1286 |
| 75805 | 75820 | 528970 | CTACCTAAGGCCATGA | e-e-e-d(10)-k-k-k | 55 | 1287 |
| 75806 | 75821 | 528971 | GCTACCTAAGGCCATG | e-e-e-d(10)-k-k-k | 66 | 1288 |
| 75807 | 75822 | 528972 | TGCTACCTAAGGCCAT | e-e-e-d(10)-k-k-k | 56 | 1289 |
| 75808 | 75823 | 528973 | ATGCTACCTAAGGCCA | e-e-e-d(10)-k-k-k | 71 | 1290 |
| 75809 | 75824 | 528974 | CATGCTACCTAAGGCC | e-e-e-d(10)-k-k-k | 58 | 1291 |
| 75810 | 75825 | 528975 | ACATGCTACCTAAGGC | e-e-e-d(10)-k-k-k | 34 | 1292 |
| 75823 | 75838 | 528976 | GTTAAGACCAGATACA | e-e-e-d(10)-k-k-k | 45 | 1293 |
| 75824 | 75839 | 528977 | AGTTAAGACCAGATAC | e-e-e-d(10)-k-k-k | 40 | 1294 |
| 75825 | 75840 | 528978 | GAGTTAAGACCAGATA | e-e-e-d(10)-k-k-k | 40 | 1295 |
| 75826 | 75841 | 528979 | AGAGTTAAGACCAGAT | e-e-e-d(10)-k-k-k | 62 | 1296 |
| 75831 | 75846 | 530399 | CAATCAGAGTTAAGAC | k-d(10)-k-e-k-e-e | 36 | 1297 |
| 75832 | 75848 | 530029 | TACAATCAGAGTTAAGA | e-e-k-d(10)-k-e-k-e | 29 | 1298 |
| 75832 | 75847 | 530349 | ACAATCAGAGTTAAGA | e-k-d(10)-k-e-k-e | 33 | 1299 |
| 75833 | 75848 | 528980 | TACAATCAGAGTTAAG | e-e-e-d(10)-k-k-k | 0 | 378 |
| 75833 | 75848 | 530097 | TACAATCAGAGTTAAG | e-k-k-d(10)-k-k-e | 41 | 378 |
| 75833 | 75848 | 530144 | TACAATCAGAGTTAAG | e-e-k-d(10)-k-e-e | 16 | 378 |
| 75833 | 75848 | 530194 | TACAATCAGAGTTAAG | e-d-k-d(10)-k-e-e | 28 | 378 |
| 75833 | 75848 | 530244 | TACAATCAGAGTTAAG | e-d-d-k-d(9)-k-k-e | 0 | 378 |
| 75833 | 75848 | 530294 | TACAATCAGAGTTAAG | e-e-e-e-d(9)-k-k-e | 7 | 378 |
| 75835 | 75850 | 528981 | GCTACAATCAGAGTTA | e-e-e-d(10)-k-k-k | 52 | 1300 |
| 75836 | 75851 | 528982 | TGCTACAATCAGAGTT | e-e-e-d(10)-k-k-k | 47 | 1301 |
| 75837 | 75852 | 528983 | TTGCTACAATCAGAGT | e-e-e-d(10)-k-k-k | 44 | 1302 |
| 75849 | 75864 | 530400 | CTCTCAGAACTTTGC | k-d(10)-k-e-k-e-e | 65 | 1303 |
| 75850 | 75866 | 530030 | TCCTCTCAGAACTTTTG | e-e-k-d(10)-k-e-k-e | 47 | 1304 |
| 75850 | 75865 | 530350 | CCTCTCAGAACTTTTG | e-k-d(10)-k-e-k-e | 54 | 1305 |
| 75851 | 75866 | 530098 | TCCTCTCAGAACTTTT | e-k-k-d(10)-k-k-e | 42 | 380 |
| 75851 | 75866 | 530145 | TCCTCTCAGAACTTTT | e-e-k-d(10)-k-e-e | 38 | 380 |
| 75851 | 75866 | 530195 | TCCTCTCAGAACTTTT | e-d-k-d(10)-k-e-e | 43 | 380 |
| 75851 | 75866 | 530245 | TCCTCTCAGAACTTTT | e-d-d-k-d(9)-k-k-e | 28 | 380 |
| 75851 | 75866 | 530295 | TCCTCTCAGAACTTTT | e-e-e-e-d(9)-k-k-e | 39 | 380 |
| 75957 | 75972 | 528984 | CCCACGGGATTCCCTC | e-e-e-d(10)-k-k-k | 39 | 1306 |
| 75958 | 75973 | 528985 | ACCCACGGGATTCCCT | e-e-e-d(10)-k-k-k | 36 | 1307 |
| 75959 | 75974 | 528986 | AACCCACGGGATTCCC | e-e-e-d(10)-k-k-k | 47 | 1308 |
| 75960 | 75975 | 528987 | CAACCCACGGGATTCC | e-e-e-d(10)-k-k-k | 39 | 1309 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 75961 | 75976 | 528988 | GCAACCCACGGGATTC | e-e-e-d(10)-k-k-k | 48 | 1310 |
| 75962 | 75977 | 528989 | AGCAACCCACGGGATT | e-e-e-d(10)-k-k-k | 40 | 1311 |
| 75964 | 75979 | 528990 | TAAGCAACCCACGGGA | e-e-e-d(10)-k-k-k | 27 | 1312 |
| 75965 | 75980 | 528991 | GTAAGCAACCCACGGG | e-e-e-d(10)-k-k-k | 47 | 1313 |
| 75966 | 75981 | 528992 | GGTAAGCAACCCACGG | e-e-e-d(10)-k-k-k | 42 | 1314 |
| 75967 | 75982 | 528993 | AGGTAAGCAACCCACG | e-e-e-d(10)-k-k-k | 54 | 1315 |
| 75967 | 75982 | 530434 | AGGTAAGCAACCCACG | k-d(10)-k-e-k-e-e | 51 | 1315 |
| 75968 | 75983 | 528994 | TAGGTAAGCAACCCAC | e-e-e-d(10)-k-k-k | 53 | 1316 |
| 75968 | 75984 | 530064 | GTAGGTAAGCAACCCAC | e-e-k-d(10)-k-e-k-e | 53 | 1317 |
| 75968 | 75983 | 530384 | TAGGTAAGCAACCCAC | e-k-d(10)-k-k-k-e | 48 | 1316 |
| 75969 | 75984 | 528995 | GTAGGTAAGCAACCCA | e-e-e-d(10)-k-k-k | 64 | 388 |
| 75969 | 75984 | 530129 | GTAGGTAAGCAACCCA | e-e-k-d(10)-k-e-k-e | 79 | 388 |
| 75969 | 75984 | 530179 | GTAGGTAAGCAACCCA | e-e-k-d(10)-k-e-k-e | 74 | 388 |
| 75969 | 75984 | 530229 | GTAGGTAAGCAACCCA | e-d-k-d(10)-k-k-e | 64 | 388 |
| 75969 | 75984 | 530279 | GTAGGTAAGCAACCCA | e-d-d-k-d(9)-k-k-e | 55 | 388 |
| 75969 | 75984 | 530329 | GTAGGTAAGCAACCCA | e-e-e-e-d(9)-k-k-e | 61 | 388 |
| 75971 | 75986 | 528996 | AGGTAGGTAAGCAACC | e-e-e-d(10)-k-k-k | 21 | 1318 |
| 75975 | 75990 | 528997 | TTATAGGTAGGTAAGC | e-e-e-d(10)-k-k-k | 10 | 1319 |
| 75979 | 75994 | 528998 | CACCTTATAGGTAGGT | e-e-e-d(10)-k-k-k | 22 | 1320 |
| 75981 | 75996 | 528999 | ACCACCTTATAGGTAG | e-e-e-d(10)-k-k-k | 15 | 1321 |
| 75984 | 75999 | 529000 | TAAACCACCTTATAGG | e-e-e-d(10)-k-k-k | 0 | 1322 |
| 75985 | 76000 | 529001 | ATAAACCACCTTATAG | e-e-e-d(10)-k-k-k | 7 | 1323 |
| 75997 | 76012 | 529002 | GGACAGCAGCTTATAA | e-e-e-d(10)-k-k-k | 12 | 1324 |
| 75998 | 76013 | 529003 | AGGACAGCAGCTTATA | e-e-e-d(10)-k-k-k | 40 | 1325 |
| 75998 | 76013 | 530401 | AGGACAGCAGCTTATA | k-d(10)-k-e-k-e-e | 41 | 1325 |
| 75999 | 76014 | 529004 | CAGGACAGCAGCTTAT | e-e-e-d(10)-k-k-k | 38 | 1326 |
| 75999 | 76015 | 530031 | CCAGGACAGCAGCTTAT | e-e-k-d(10)-k-e-k-e | 58 | 1327 |
| 75999 | 76014 | 530351 | CAGGACAGCAGCTTAT | e-k-d(10)-k-e-k-e | 58 | 1326 |
| 75999 | 76014 | 530402 | CAGGACAGCAGCTTAT | k-d(10)-k-e-k-e-e | 60 | 1326 |
| 76000 | 76016 | 530032 | GCCAGGACAGCAGCTTA | e-e-k-d(10)-k-e-k-e | 74 | 1328 |
| 76000 | 76015 | 530099 | CCAGGACAGCAGCTTA | e-k-k-d(10)-k-e-k-e | 73 | 1329 |
| 76000 | 76015 | 530146 | CCAGGACAGCAGCTTA | e-e-k-d(10)-k-e-k-e | 70 | 1329 |
| 76000 | 76015 | 530196 | CCAGGACAGCAGCTTA | e-d-k-d(10)-k-k-e | 67 | 1329 |
| 76000 | 76015 | 530246 | CCAGGACAGCAGCTTA | e-d-d-k-d(9)-k-k-e | 39 | 1329 |
| 76000 | 76015 | 530296 | CCAGGACAGCAGCTTA | e-e-e-d(9)-k-k-e | 67 | 1329 |
| 76000 | 76015 | 530352 | CCAGGACAGCAGCTTA | e-k-d(10)-k-e-k-e | 67 | 1329 |
| 76001 | 76016 | 530100 | GCCAGGACAGCAGCTT | e-k-k-d(10)-k-k-e | 77 | 1330 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 76001 | 76016 | 530147 | GCCAGGACAGCAGCTT | e-e-k-d(10)-k-k-e | 84 | 1330 |
| 76001 | 76016 | 530197 | GCCAGGACAGCAGCTT | e-d-k-d(10)-k-k-e | 71 | 1330 |
| 76001 | 76016 | 530247 | GCCAGGACAGCAGCTT | e-d-d-k-d(9)-k-k-e | 53 | 1330 |
| 76001 | 76016 | 530297 | GCCAGGACAGCAGCTT | e-e-e-d(9)-k-k-e | 75 | 1330 |
| 76001 | 76016 | 530403 | GCCAGGACAGCAGCTT | k-d(10)-k-e-k-e-e | 77 | 1330 |
| 76002 | 76018 | 530033 | TGGCCAGGACAGCAGCT | e-e-k-d(10)-k-e-k-e | 65 | 1331 |
| 76002 | 76017 | 530353 | GGCCAGGACAGCAGCT | e-k-d(10)-k-e-k-e | 83 | 1332 |
| 76003 | 76018 | 530101 | TGGCCAGGACAGCAGC | e-k-d(10)-k-k-e | 59 | 1333 |
| 76003 | 76018 | 530148 | TGGCCAGGACAGCAGC | e-e-k-d(10)-k-k-e | 79 | 1333 |
| 76003 | 76018 | 530198 | TGGCCAGGACAGCAGC | e-d-k-d(10)-k-k-e | 54 | 1333 |
| 76003 | 76018 | 530248 | TGGCCAGGACAGCAGC | e-d-d-k-d(9)-k-k-e | 32 | 1333 |
| 76003 | 76018 | 530298 | TGGCCAGGACAGCAGC | e-e-e-d(9)-k-k-e | 73 | 1333 |
| 76014 | 76029 | 530404 | TTTGAATGCAGTGGCC | k-d(10)-k-e-k-e-e | 67 | 1334 |
| 76015 | 76031 | 530034 | AATTTGAATGCAGTGGC | e-e-k-d(10)-k-e-k-e | 69 | 1335 |
| 76015 | 76030 | 530354 | ATTTGAATGCAGTGGC | e-k-d(10)-k-e-k-e | 85 | 1336 |
| 76015 | 76030 | 530405 | ATTTGAATGCAGTGGC | k-d(10)-k-e-k-e-e | 55 | 1336 |
| 76016 | 76032 | 530035 | GAATTTGAATGCAGTGG | e-e-k-d(10)-k-e-k-e | 69 | 1337 |
| 76016 | 76031 | 530102 | AATTTGAATGCAGTGG | e-k-d(10)-k-k-e | 71 | 1338 |
| 76016 | 76031 | 530149 | AATTTGAATGCAGTGG | e-e-k-d(10)-k-k-e | 70 | 1338 |
| 76016 | 76031 | 530199 | AATTTGAATGCAGTGG | e-d-k-d(10)-k-k-e | 58 | 1338 |
| 76016 | 76031 | 530249 | AATTTGAATGCAGTGG | e-d-d-k-d(9)-k-k-e | 47 | 1338 |
| 76016 | 76031 | 530299 | AATTTGAATGCAGTGG | e-e-e-d(9)-k-k-e | 47 | 1338 |
| 76016 | 76031 | 530355 | AATTTGAATGCAGTGG | e-k-d(10)-k-e-k-e | 72 | 1338 |
| 76017 | 76032 | 530103 | GAATTTGAATGCAGTG | e-k-d(10)-k-k-e | 77 | 390 |
| 76017 | 76032 | 530150 | GAATTTGAATGCAGTG | e-e-k-d(10)-k-k-e | 73 | 390 |
| 76017 | 76032 | 530200 | GAATTTGAATGCAGTG | e-d-k-d(10)-k-k-e | 63 | 390 |
| 76017 | 76032 | 530250 | GAATTTGAATGCAGTG | e-d-d-k-d(9)-k-k-e | 59 | 390 |
| 76017 | 76032 | 530300 | GAATTTGAATGCAGTG | e-e-e-d(9)-k-k-e | 65 | 390 |
| 76029 | 76044 | 530435 | AAGTACACATTGGAAT | k-d(10)-k-e-k-e-e | 62 | 1339 |
| 76030 | 76046 | 530057 | TGAAGTACACATTGGAA | e-e-k-d(10)-k-e-k-e | 69 | 1340 |
| 76030 | 76045 | 530385 | GAAGTACACATTGGAA | e-k-d(10)-k-e-k-e | 70 | 1341 |
| 76031 | 76046 | 529005 | TGAAGTACACATTGGA | e-e-e-d(10)-k-k-k | 64 | 392 |
| 76031 | 76046 | 530130 | TGAAGTACACATTGGA | e-k-d(10)-k-e-k-e | 85 | 392 |
| 76031 | 76046 | 530180 | TGAAGTACACATTGGA | e-e-k-d(10)-k-k-e | 82 | 392 |
| 76031 | 76046 | 530230 | TGAAGTACACATTGGA | e-d-k-d(10)-k-k-e | 65 | 392 |
| 76031 | 76046 | 530280 | TGAAGTACACATTGGA | e-d-d-k-d(9)-k-k-e | 75 | 392 |

TABLE 14-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 76031 | 76046 | 530330 | TGAAGTACACATTGGA | e-e-e-e-d(9)-k-k-e | 52 | 392 |
| 76039 | 76054 | 529006 | TTACACTATGAAGTAC | e-e-e-d(10)-k-k-k | 16 | 1342 |
| 76116 | 76131 | 529007 | AGTTAAAGTAGATACA | e-e-e-d(10)-k-k-k | 0 | 1343 |
| 76121 | 76136 | 529008 | CTGGAAGTTAAAGTAG | e-e-e-d(10)-k-k-k | 30 | 397 |
| 76130 | 76145 | 529009 | CGTTTATTTCTGGAAG | e-e-e-d(10)-k-k-k | 52 | 1344 |
| 76144 | 76159 | 529010 | CGGTTCCTATATAACG | e-e-e-d(10)-k-k-k | 21 | 1345 |
| 76145 | 76160 | 529011 | ACGGTTCCTATATAAC | e-e-e-d(10)-k-k-k | 10 | 1346 |

Example 14

Dose-Dependent Antisense Inhibition of Human STAT3 in HuVEC Cells

Gapmers from the study described in Example 13 exhibiting significant in vitro inhibition of STAT3 were tested at various doses in HuVEC cells. Cells were plated at a density of 20,000 cells per well and transfected using electroporation with 39.1 nM, 156.3 nM, 625.0 nM, and 2,500.0 nM concentrations of antisense oligonucleotide, as specified in Table 15. After a treatment period of approximately 16 hours, RNA was isolated from the cells and STAT3 mRNA levels were measured by quantitative real-time PCR. Human STAT3 primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 15. As illustrated in Table 15, STAT3 mRNA levels were significantly reduced in a dose-dependent manner in antisense oligonucleotide treated cells.

TABLE 15

Dose-dependent antisense inhibition of human STAT3 in HuVEC cells

| ISIS No | 39.1 nM | 156.3 nM | 625.0 nM | 2500.0 nM | $IC_{50}$ (μM) |
|---|---|---|---|---|---|
| 481464 | 6 | 51 | 84 | 94 | 0.2 |
| 518345 | 0 | 9 | 56 | 84 | 0.6 |
| 518349 | 16 | 3 | 47 | 83 | 0.6 |
| 519636 | 16 | 41 | 75 | 89 | 0.2 |
| 519637 | 24 | 43 | 84 | 94 | 0.2 |
| 519638 | 6 | 34 | 70 | 92 | 0.3 |
| 528403 | 0 | 4 | 39 | 77 | 0.9 |
| 528458 | 0 | 15 | 46 | 81 | 0.7 |
| 528475 | 1 | 10 | 51 | 76 | 0.7 |
| 528476 | 0 | 11 | 42 | 80 | 0.7 |
| 528869 | 25 | 19 | 67 | 86 | 0.3 |
| 528880 | 0 | 3 | 45 | 76 | 0.8 |
| 528937 | 0 | 1 | 49 | 82 | 0.8 |
| 528938 | 0 | 9 | 50 | 82 | 0.7 |
| 528942 | 0 | 20 | 59 | 88 | 0.5 |
| 528959 | 0 | 4 | 55 | 79 | 0.7 |
| 529022 | 0 | 0 | 52 | 81 | 0.8 |
| 529023 | 0 | 0 | 53 | 90 | 0.6 |
| 529024 | 0 | 0 | 47 | 80 | 0.8 |
| 529025 | 0 | 11 | 50 | 90 | 0.6 |
| 529026 | 0 | 31 | 73 | 96 | 0.4 |
| 529027 | 0 | 7 | 36 | 80 | 0.9 |
| 530021 | 6 | 30 | 69 | 92 | 0.3 |
| 530025 | 10 | 33 | 73 | 92 | 0.3 |
| 530026 | 3 | 18 | 52 | 80 | 0.6 |
| 530041 | 0 | 28 | 72 | 91 | 0.4 |
| 530048 | 0 | 22 | 53 | 83 | 0.5 |
| 530049 | 2 | 16 | 69 | 92 | 0.4 |
| 530053 | 0 | 16 | 66 | 90 | 0.5 |
| 530062 | 4 | 56 | 85 | 94 | 0.2 |
| 530066 | 0 | 12 | 46 | 84 | 0.7 |
| 530088 | 2 | 39 | 77 | 93 | 0.3 |
| 530091 | 3 | 12 | 59 | 84 | 0.5 |
| 530092 | 7 | 27 | 65 | 85 | 0.4 |
| 530093 | 7 | 46 | 79 | 96 | 0.2 |
| 530094 | 0 | 17 | 63 | 89 | 0.5 |
| 530110 | 9 | 30 | 72 | 94 | 0.3 |
| 530110 | 0 | 23 | 61 | 83 | 0.5 |
| 530112 | 0 | 13 | 42 | 90 | 0.6 |
| 530114 | 0 | 21 | 62 | 79 | 0.6 |
| 530116 | 22 | 40 | 71 | 92 | 0.2 |
| 530123 | 8 | 19 | 72 | 93 | 0.3 |
| 530130 | 0 | 33 | 64 | 89 | 0.4 |
| 530131 | 4 | 34 | 81 | 93 | 0.3 |
| 530135 | 22 | 38 | 79 | 94 | 0.2 |
| 530138 | 6 | 23 | 57 | 86 | 0.4 |
| 530140 | 4 | 22 | 62 | 91 | 0.4 |
| 530147 | 0 | 15 | 51 | 83 | 0.6 |
| 530156 | 7 | 41 | 81 | 96 | 0.2 |
| 530161 | 0 | 20 | 46 | 78 | 0.7 |
| 530170 | 0 | 29 | 67 | 90 | 0.4 |
| 530175 | 37 | 52 | 84 | 95 | 0.1 |
| 530178 | 8 | 24 | 70 | 86 | 0.4 |
| 530180 | 0 | 0 | 61 | 82 | 0.6 |
| 530181 | 0 | 27 | 52 | 86 | 0.5 |
| 530185 | 0 | 22 | 54 | 86 | 0.5 |
| 530190 | 17 | 17 | 60 | 87 | 0.4 |
| 530206 | 8 | 29 | 73 | 93 | 0.3 |
| 530225 | 0 | 27 | 67 | 91 | 0.4 |
| 530228 | 11 | 16 | 64 | 86 | 0.4 |
| 530261 | 5 | 25 | 57 | 91 | 0.4 |
| 530270 | 7 | 11 | 62 | 91 | 0.4 |
| 530275 | 14 | 34 | 73 | 91 | 0.3 |
| 530278 | 1 | 27 | 60 | 85 | 0.4 |
| 530285 | 5 | 20 | 61 | 82 | 0.5 |

TABLE 15-continued

Dose-dependent antisense inhibition of human STAT3 in HuVEC cells

| ISIS No | 39.1 nM | 156.3 nM | 625.0 nM | 2500.0 nM | IC$_{50}$ (µM) |
|---|---|---|---|---|---|
| 530306 | 3 | 14 | 66 | 85 | 0.5 |
| 530311 | 6 | 27 | 59 | 86 | 0.4 |
| 530320 | 3 | 17 | 56 | 85 | 0.5 |
| 530325 | 5 | 35 | 70 | 92 | 0.3 |
| 530328 | 4 | 34 | 61 | 87 | 0.4 |
| 530340 | 8 | 34 | 74 | 90 | 0.3 |
| 530341 | 2 | 23 | 77 | 89 | 0.4 |
| 530344 | 16 | 20 | 64 | 89 | 0.4 |
| 530345 | 15 | 35 | 77 | 94 | 0.2 |
| 530346 | 5 | 24 | 66 | 92 | 0.4 |
| 530353 | 7 | 25 | 57 | 83 | 0.5 |
| 530354 | 2 | 24 | 60 | 81 | 0.5 |
| 530359 | 0 | 4 | 44 | 89 | 0.7 |
| 530361 | 13 | 30 | 59 | 92 | 0.3 |
| 530365 | 0 | 0 | 45 | 88 | 0.7 |
| 530367 | 0 | 15 | 49 | 88 | 0.5 |
| 530368 | 0 | 27 | 64 | 89 | 0.4 |
| 530369 | 10 | 28 | 78 | 95 | 0.3 |
| 530373 | 13 | 29 | 64 | 92 | 0.3 |
| 530375 | 0 | 14 | 53 | 90 | 0.5 |
| 530380 | 8 | 40 | 80 | 94 | 0.2 |
| 530390 | 11 | 21 | 66 | 90 | 0.4 |
| 530391 | 20 | 7 | 49 | 86 | 0.5 |
| 530411 | 5 | 19 | 81 | 95 | 0.3 |
| 530430 | 0 | 8 | 53 | 91 | 0.6 |
| 530466 | 0 | 4 | 53 | 87 | 0.6 |
| 530468 | 4 | 17 | 65 | 90 | 0.4 |
| 530469 | 8 | 38 | 86 | 94 | 0.2 |
| 530470 | 5 | 39 | 78 | 91 | 0.3 |
| 530471 | 0 | 21 | 69 | 91 | 0.4 |
| 530476 | 7 | 9 | 32 | 89 | 0.7 |
| 530477 | 0 | 12 | 64 | 87 | 0.5 |
| 530478 | 0 | 14 | 59 | 90 | 0.5 |
| 530485 | 0 | 10 | 61 | 85 | 0.5 |
| 530486 | 0 | 17 | 64 | 80 | 0.5 |
| 530492 | 0 | 25 | 71 | 89 | 0.4 |
| 530493 | 4 | 23 | 58 | 88 | 0.4 |
| 530507 | 5 | 17 | 65 | 82 | 0.5 |
| 530508 | 0 | 14 | 56 | 89 | 0.5 |
| 530509 | 0 | 17 | 54 | 86 | 0.5 |
| 530513 | 6 | 24 | 74 | 91 | 0.3 |
| 530514 | 1 | 7 | 52 | 78 | 0.7 |
| 530515 | 0 | 19 | 73 | 89 | 0.4 |

Example 15

Antisense Inhibition of Human STAT3 in HuVEC Cells

Additional antisense oligonucleotides were designed targeting a STAT3 nucleic acid and were tested for their effects on STAT3 mRNA in vitro. Cultured HuVEC cells at a density of 20,000 cells per well were transfected using electroporation with 1,000 nM antisense oligonucleotide. After a treatment period of approximately 24 hours, RNA was isolated from the cells and STAT3 mRNA levels were measured by quantitative real-time PCR. Human primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

The chimeric antisense oligonucleotides in Table 16 are 3-10-3 deoxy, MOE and cEt gapmers or 3-10-4 deoxy, MOE and cEt gapmers. The 3-10-3 gapmers are 16 nucleosides in length, wherein the central gap segment comprises ten 2'-deoxynucleosides and is flanked on both sides (in the 5' and 3' directions) by wings comprising 3 nucleosides each. The 3-10-4 gapmers are 17 nucleosides in length, wherein the central gap segment comprises ten 2'-deoxynucleosides and is flanked on the 5' directions by a wing comprising 3 nucleosides and on the 3' direction by a wing comprising 4 nucleosides. The internucleoside linkages throughout each gapmer are phosphorothioate (P=S) linkages. All cytosine residues throughout each gapmer are 5'-methylcytosines. The chemistry column of Table 16 presents the sugar motif of each gapmer, where 'e' indicates a 2'-MOE nucleoside, 'k' indicates a constrained ethyl (cEt) nucleoside, and 'd' indicates a 2'-deoxynucleoside.

"Human Target start site" indicates the 5'-most nucleoside to which the gapmer is targeted in the human gene sequence. "Human Target stop site" indicates the 3'-most nucleoside to which the gapmer is targeted in the human gene sequence. Each gapmer listed in Table 16 is targeted to human STAT3 mRNA, designated herein as SEQ ID NO: 1 (GENBANK Accession No. NM_139276.2). Each gapmer listed in Table 17 is targeted to human STAT3 genomic sequence, designated herein as SEQ ID NO: 2 (the complement of GENBANK Accession No. NT 010755.14 truncated from nucleotides 4185000 to 4264000).

TABLE 16

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 730 | 745 | 530011 | GGAGATTCTCTACCAC | k-k-k-d(10)-e-e-e | 73 | 53 |
| 1901 | 1916 | 529974 | AAGCCCTTGCCAGCCA | e-e-e-d(10)-k-k-k | 83 | 144 |
| 1901 | 1916 | 530012 | AAGCCCTTGCCAGCCA | k-k-k-d(10)-e-e-e | 73 | 144 |
| 2206 | 2221 | 530015 | CCATGATCTTATAGCC | k-k-k-d(10)-e-e-e | 38 | 175 |
| 3016 | 3031 | 481464 | CTATTTGGATGTCAGC | k-k-k-d(10)-k-k-k | 94 | 245 |
| 3461 | 3476 | 529975 | AGCACCAAGGAGGCTG | e-e-e-d(10)-k-k-k | 54 | 257 |
| 3461 | 3476 | 530013 | AGCACCAAGGAGGCTG | k-k-k-d(10)-e-e-e | 58 | 257 |
| 3584 | 3600 | 530018 | TCCTTAAACCTTCCTAT | e-e-k-d(10)-k-e-k-e | 46 | 1510 |

TABLE 16-continued

Inhibition of human STAT3 mRNA levels by chimeric antisense oligonucleotides targeted to SEQ ID NO: 1

| Human Start Site | Human Stop Site | ISIS No | Sequence | Chemistry | % inhibition | SEQ ID NO |
|---|---|---|---|---|---|---|
| 3585 | 3600 | 529944 | TCCTTAAACCTTCCTA | e-e-e-d(10)-k-k-k | 44 | 273 |
| 3585 | 3600 | 529977 | TCCTTAAACCTTCCTA | k-k-k-d(10)-e-e-e | 66 | 273 |
| 3592 | 3608 | 530019 | TTAGATTCTCCTTAAAC | e-e-k-d(10)-k-e-k-e | 43 | 1511 |
| 3593 | 3608 | 529945 | TTAGATTCTCCTTAAA | e-e-e-d(10)-k-k-k | 22 | 1166 |
| 3593 | 3608 | 529978 | TTAGATTCTCCTTAAA | k-k-k-d(10)-e-e-e | 49 | 1166 |
| 3596 | 3612 | 530020 | ATGCTTAGATTCTCCTT | e-e-e-d(10)-k-e-k-e | 85 | 1512 |
| 3597 | 3612 | 529979 | ATGCTTAGATTCTCCT | k-k-k-d(10)-e-e-e | 86 | 1169 |
| 3599 | 3614 | 529946 | AAATGCTTAGATTCTC | e-e-e-d(10)-k-k-k | 46 | 1172 |
| 3599 | 3614 | 529980 | AAATGCTTAGATTCTC | k-k-k-d(10)-e-e-e | 25 | 1172 |
| 3716 | 3731 | 529947 | CAGATCAAGTCCAGGG | e-e-e-d(10)-k-k-k | 68 | 1187 |
| 3716 | 3731 | 529981 | CAGATCAAGTCCAGGG | k-k-k-d(10)-e-e-e | 83 | 1187 |
| 3718 | 3733 | 529948 | AGCAGATCAAGTCCAG | e-e-e-d(10)-k-k-k | 75 | 1190 |
| 3718 | 3733 | 529982 | AGCAGATCAAGTCCAG | k-k-k-d(10)-e-e-e | 84 | 1190 |
| 4236 | 4251 | 529983 | AGGTGTTCCCATACGC | k-k-k-d(10)-e-e-e | 96 | 1245 |
| 4237 | 4252 | 529984 | TAGGTGTTCCCATACG | k-k-k-d(10)-e-e-e | 91 | 336 |
| 4437 | 4452 | 529949 | CATCAACTGTCTCCAG | e-e-e-d(10)-k-k-k | 48 | 354 |
| 4437 | 4452 | 529985 | CATCAACTGTCTCCAG | k-k-k-d(10)-e-e-e | 37 | 354 |
| 4439 | 4454 | 529950 | CACATCAACTGTCTCC | e-e-e-d(10)-k-k-k | 58 | 356 |
| 4439 | 4454 | 529986 | CACATCAACTGTCTCC | k-k-k-d(10)-e-e-e | 72 | 356 |
| 4646 | 4661 | 529987 | TACAATCAGAGTTAAG | k-k-k-d(10)-e-e-e | 0 | 378 |
| 4664 | 4679 | 529951 | TCCTCTCAGAACTTTT | e-e-e-d(10)-k-k-k | 38 | 380 |
| 4664 | 4679 | 529988 | TCCTCTCAGAACTTTT | k-k-k-d(10)-e-e-e | 40 | 380 |
| 4782 | 4797 | 530016 | GTAGGTAAGCAACCCA | k-k-k-d(10)-e-e-e | 60 | 388 |
| 4813 | 4828 | 529952 | CCAGGACAGCAGCTTA | e-e-e-d(10)-k-k-k | 65 | 1329 |
| 4813 | 4828 | 529989 | CCAGGACAGCAGCTTA | k-k-k-d(10)-e-e-e | 63 | 1329 |
| 4814 | 4829 | 529953 | GCCAGGACAGCAGCTT | e-e-e-d(10)-k-k-k | 65 | 1330 |
| 4814 | 4829 | 529990 | GCCAGGACAGCAGCTT | k-k-k-d(10)-e-e-e | 75 | 1330 |
| 4816 | 4831 | 529954 | TGGCCAGGACAGCAGC | e-e-e-d(10)-k-k-k | 79 | 1333 |
| 4816 | 4831 | 529991 | TGGCCAGGACAGCAGC | k-k-k-d(10)-e-e-e | 52 | 1333 |
| 4829 | 4844 | 529955 | AATTTGAATGCAGTGG | e-e-e-d(10)-k-k-k | 52 | 1338 |
| 4829 | 4844 | 529992 | AATTTGAATGCAGTGG | k-k-k-d(10)-e-e-e | 23 | 1338 |
| 4830 | 4845 | 529956 | GAATTTGAATGCAGTG | e-e-e-d(10)-k-k-k | 60 | 390 |
| 4830 | 4845 | 529993 | GAATTTGAATGCAGTG | k-k-k-d(10)-e-e-e | 51 | 390 |
| 4844 | 4859 | 530014 | TGAAGTACACATTGGA | k-k-k-d(10)-e-e-e | 67 | 392 |

TABLE 17

Inhibition of human STAT3 mRNA levels by chimeric antisense oligonucleotides targeted to SEQ ID NO: 2

| Human Start Site | Human Stop Site | Sequence | ISIS No | Chemistry | % inhibition | SEQ ID NO |
|---|---|---|---|---|---|---|
| 74203 | 74218 | CTATTTGGATGTCAGC | 481464 | k-k-k-d(10)-k-k-k | 94 | 245 |
| 74772 | 74787 | TCCTTAAACCTTCCTA | 529944 | e-e-e-d(10)-k-k-k | 44 | 273 |
| 74780 | 74795 | TTAGATTCTCCTTAAA | 529945 | e-e-e-d(10)-k-k-k | 22 | 1166 |
| 74786 | 74801 | AAATGCTTAGATTCTC | 529946 | e-e-e-d(10)-k-k-k | 46 | 1172 |
| 74903 | 74918 | CAGATCAAGTCCAGGG | 529947 | e-e-e-d(10)-k-k-k | 68 | 1187 |
| 74905 | 74920 | AGCAGATCAAGTCCAG | 529948 | e-e-e-d(10)-k-k-k | 75 | 1190 |
| 75624 | 75639 | CATCAACTGTCTCCAG | 529949 | e-e-e-d(10)-k-k-k | 48 | 354 |
| 75626 | 75641 | CACATCAACTGTCTCC | 529950 | e-e-e-d(10)-k-k-k | 58 | 356 |
| 75851 | 75866 | TCCTCTCAGAACTTTT | 529951 | e-e-e-d(10)-k-k-k | 38 | 380 |
| 76000 | 76015 | CCAGGACAGCAGCTTA | 529952 | e-e-e-d(10)-k-k-k | 65 | 1329 |
| 76001 | 76016 | GCCAGGACAGCAGCTT | 529953 | e-e-e-d(10)-k-k-k | 65 | 1330 |
| 76003 | 76018 | TGGCCAGGACAGCAGC | 529954 | e-e-e-d(10)-k-k-k | 79 | 1333 |
| 76016 | 76031 | AATTTGAATGCAGTGG | 529955 | e-e-e-d(10)-k-k-k | 52 | 1338 |
| 76017 | 76032 | GAATTTGAATGCAGTG | 529956 | e-e-e-d(10)-k-k-k | 60 | 390 |
| 2340 | 2355 | ACATACAGTAAGACCA | 529957 | e-e-e-d(10)-k-k-k | 21 | 1376 |
| 2385 | 2400 | CAAAAATTTACAACCC | 529958 | e-e-e-d(10)-k-k-k | 10 | 1380 |
| 2410 | 2425 | CCAATGCTTTATCAGC | 529959 | e-e-e-d(10)-k-k-k | 51 | 1384 |
| 2671 | 2686 | AGACTAAAATCAAGGC | 529960 | e-e-e-d(10)-k-k-k | 30 | 1388 |
| 5002 | 5017 | AACTGAAATTCCTTGG | 529961 | e-e-e-d(10)-k-k-k | 52 | 1395 |
| 5701 | 5716 | GTACTCTTTCAGTGGT | 529962 | e-e-e-d(10)-k-k-k | 91 | 1399 |
| 8080 | 8095 | GCAGATTTACCTTCCT | 529963 | e-e-e-d(10)-k-k-k | 55 | 1409 |
| 9125 | 9140 | CTGCCCCTATGTATAA | 529964 | e-e-e-d(10)-k-k-k | 18 | 1413 |
| 11263 | 11278 | CTGCCCCTATGTATAA | 529964 | e-e-e-d(10)-k-k-k | 18 | 1413 |
| 9864 | 9879 | GCTTCTTCCTGAGACA | 529965 | e-e-e-d(10)-k-k-k | 52 | 1417 |
| 12347 | 12362 | GCTTCTTCCTGAGACA | 529965 | e-e-e-d(10)-k-k-k | 52 | 1417 |
| 9866 | 9881 | TGGCTTCTTCCTGAGA | 529966 | e-e-e-d(10)-k-k-k | 51 | 1420 |
| 12349 | 12364 | TGGCTTCTTCCTGAGA | 529966 | e-e-e-d(10)-k-k-k | 51 | 1420 |
| 9875 | 9890 | TCCTCCTGTTGGCTTC | 529967 | e-e-e-d(10)-k-k-k | 80 | 1425 |
| 12358 | 12373 | TCCTCCTGTTGGCTTC | 529967 | e-e-e-d(10)-k-k-k | 80 | 1425 |
| 9876 | 9891 | TTCCTCCTGTTGGCTT | 529968 | e-e-e-d(10)-k-k-k | 56 | 1426 |
| 12359 | 12374 | TTCCTCCTGTTGGCTT | 529968 | e-e-e-d(10)-k-k-k | 56 | 1426 |
| 9878 | 9893 | GGTTCCTCCTGTTGGC | 529969 | e-e-e-d(10)-k-k-k | 69 | 1429 |
| 12361 | 12376 | GGTTCCTCCTGTTGGC | 529969 | e-e-e-d(10)-k-k-k | 69 | 1429 |
| 16865 | 16880 | TATAATTGTGTACTGG | 529970 | e-e-e-d(10)-k-k-k | 41 | 1441 |
| 26063 | 26078 | CAACTTTAGCCCCTTC | 529971 | e-e-e-d(10)-k-k-k | 32 | 1452 |
| 48404 | 48419 | CACACTTTCCATTCTA | 529972 | e-e-e-d(10)-k-k-k | 30 | 1476 |
| 71616 | 71631 | CAGTACAATTGCTTCA | 529973 | e-e-e-d(10)-k-k-k | 49 | 1505 |

TABLE 17-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 66138 | 66153 | AAGCCCTTGCCAGCCA | 529974 | e-e-e-d(10)-k-k-k | 83 | 144 |
| 74648 | 74663 | AGCACCAAGGAGGCTG | 529975 | e-e-e-d(10)-k-k-k | 54 | 257 |
| 2705 | 2720 | CTAATGGTTCTTTGTG | 529976 | e-e-e-d(10)-k-k-k | 25 | 411 |
| 74772 | 74787 | TCCTTAAACCTTCCTA | 529977 | k-k-k-d(10)-e-e-e | 66 | 273 |
| 74780 | 74795 | TTAGATTCTCCTTAAA | 529978 | k-k-k-d(10)-e-e-e | 49 | 1166 |
| 74784 | 74799 | ATGCTTAGATTCTCCT | 529979 | k-k-k-d(10)-e-e-e | 86 | 1169 |
| 74786 | 74801 | AAATGCTTAGATTCTC | 529980 | k-k-k-d(10)-e-e-e | 25 | 1172 |
| 74903 | 74918 | CAGATCAAGTCCAGGG | 529981 | k-k-k-d(10)-e-e-e | 83 | 1187 |
| 74905 | 74920 | AGCAGATCAAGTCCAG | 529982 | k-k-k-d(10)-e-e-e | 84 | 1190 |
| 75423 | 75438 | AGGTGTTCCCATACGC | 529983 | k-k-k-d(10)-e-e-e | 96 | 1245 |
| 75424 | 75439 | TAGGTGTTCCCATACG | 529984 | k-k-k-d(10)-e-e-e | 91 | 336 |
| 75624 | 75639 | CATCAACTGTCTCCAG | 529985 | k-k-k-d(10)-e-e-e | 37 | 354 |
| 75626 | 75641 | CACATCAACTGTCTCC | 529986 | k-k-k-d(10)-e-e-e | 72 | 356 |
| 75833 | 75848 | TACAATCAGAGTTAAG | 529987 | k-k-k-d(10)-e-e-e | 0 | 378 |
| 75851 | 75866 | TCCTCTCAGAACTTTT | 529988 | k-k-k-d(10)-e-e-e | 40 | 380 |
| 76000 | 76015 | CCAGGACAGCAGCTTA | 529989 | k-k-k-d(10)-e-e-e | 63 | 1329 |
| 76001 | 76016 | GCCAGGACAGCAGCTT | 529990 | k-k-k-d(10)-e-e-e | 75 | 1330 |
| 76003 | 76018 | TGGCCAGGACAGCAGC | 529991 | k-k-k-d(10)-e-e-e | 52 | 1333 |
| 76016 | 76031 | AATTTGAATGCAGTGG | 529992 | k-k-k-d(10)-e-e-e | 23 | 1338 |
| 76017 | 76032 | GAATTTGAATGCAGTG | 529993 | k-k-k-d(10)-e-e-e | 51 | 390 |
| 2340 | 2355 | ACATACAGTAAGACCA | 529994 | k-k-k-d(10)-e-e-e | 44 | 1376 |
| 2385 | 2400 | CAAAAATTTACAACCC | 529995 | k-k-k-d(10)-e-e-e | 0 | 1380 |
| 2410 | 2425 | CCAATGCTTTATCAGC | 529996 | k-k-k-d(10)-e-e-e | 65 | 1384 |
| 2671 | 2686 | AGACTAAAATCAAGGC | 529997 | k-k-k-d(10)-e-e-e | 44 | 1388 |
| 5002 | 5017 | AACTGAAATTCCTTGG | 529998 | k-k-k-d(10)-e-e-e | 35 | 1395 |
| 5701 | 5716 | GTACTCTTTCAGTGGT | 529999 | k-k-k-d(10)-e-e-e | 91 | 1399 |
| 8080 | 8095 | GCAGATTTACCTTCCT | 530000 | k-k-k-d(10)-e-e-e | 80 | 1409 |
| 9125 | 9140 | CTGCCCCTATGTATAA | 530001 | k-k-k-d(10)-e-e-e | 21 | 1413 |
| 11263 | 11278 | CTGCCCCTATGTATAA | 530001 | k-k-k-d(10)-e-e-e | 21 | 1413 |
| 9864 | 9879 | GCTTCTTCCTGAGACA | 530002 | k-k-k-d(10)-e-e-e | 74 | 1417 |
| 12347 | 12362 | GCTTCTTCCTGAGACA | 530002 | k-k-k-d(10)-e-e-e | 74 | 1417 |
| 9866 | 9881 | TGGCTTCTTCCTGAGA | 530003 | k-k-k-d(10)-e-e-e | 67 | 1420 |
| 12349 | 12364 | TGGCTTCTTCCTGAGA | 530003 | k-k-k-d(10)-e-e-e | 67 | 1420 |
| 9875 | 9890 | TCCTCCTGTTGGCTTC | 530004 | k-k-k-d(10)-e-e-e | 83 | 1425 |
| 12358 | 12373 | TCCTCCTGTTGGCTTC | 530004 | k-k-k-d(10)-e-e-e | 83 | 1425 |
| 9876 | 9891 | TTCCTCCTGTTGGCTT | 530005 | k-k-k-d(10)-e-e-e | 77 | 1426 |

TABLE 17-continued

Inhibition of human STAT3 mRNA levels by chimeric antisense oligonucleotides targeted to SEQ ID NO: 2

| Human Start Site | Human Stop Site | ISIS No | Sequence | Chemistry | % inhibition | SEQ ID NO |
|---|---|---|---|---|---|---|
| 12359 | 12374 | 530005 | TTCCTCCTGTTGGCTT | k-k-k-d(10)-e-e-e | 77 | 1426 |
| 9878 | 9893 | 530006 | GGTTCCTCCTGTTGGC | k-k-k-d(10)-e-e-e | 89 | 1427 |
| 12361 | 12376 | 530006 | GGTTCCTCCTGTTGGC | k-k-k-d(10)-e-e-e | 89 | 1427 |
| 16865 | 16880 | 530007 | TATAATTGTGTACTGG | k-k-k-d(10)-e-e-e | 21 | 1441 |
| 26063 | 26078 | 530008 | CAACTTTAGCCCCTTC | k-k-k-d(10)-e-e-e | 58 | 1452 |
| 48404 | 48419 | 530009 | CACACTTTCCATTCTA | k-k-k-d(10)-e-e-e | 59 | 1476 |
| 71616 | 71631 | 530010 | CAGTACAATTGCTTCA | k-k-k-d(10)-e-e-e | 75 | 1505 |
| 50694 | 50709 | 530011 | GGAGATTCTCTACCAC | k-k-k-d(10)-e-e-e | 73 | 53 |
| 66138 | 66153 | 530012 | AAGCCCTTGCCAGCCA | k-k-k-d(10)-e-e-e | 73 | 144 |
| 74648 | 74663 | 530013 | AGCACCAAGGAGGCTG | k-k-k-d(10)-e-e-e | 58 | 257 |
| 76031 | 76046 | 530014 | TGAAGTACACATTGGA | k-k-k-d(10)-e-e-e | 67 | 392 |
| 67068 | 67083 | 530015 | CCATGATCTTATAGCC | k-k-k-d(10)-e-e-e | 38 | 175 |
| 75969 | 75984 | 530016 | GTAGGTAAGCAACCCA | k-k-k-d(10)-e-e-e | 60 | 388 |
| 2705 | 2720 | 530017 | CTAATGGTTCTTTGTG | k-k-k-d(10)-e-e-e | 46 | 411 |
| 74771 | 74787 | 530018 | TCCTTAAACCTTCCTAT | e-e-k-d(10)-k-e-k-e | 46 | 1510 |
| 74779 | 74795 | 530019 | TTAGATTCTCCTTAAAC | e-e-k-d(10)-k-e-k-e | 43 | 1511 |
| 74783 | 74799 | 530020 | ATGCTTAGATTCTCCTT | e-e-k-d(10)-k-e-k-e | 85 | 1512 |

Example 16

Dose-Dependent Antisense Inhibition of Human STAT3 in HuVEC Cells

Gapmers from the study described in Example 15 exhibiting significant in vitro inhibition of STAT3 were tested at various doses in HuVEC cells. Cells were plated at a density of 20,000 cells per well and transfected using electroporation with 39.1 nM, 156.3 nM, 625.0 nM, and 2,500.0 nM concentrations of antisense oligonucleotide, as specified in Table 18. After a treatment period of approximately 16 hours, RNA was isolated from the cells and STAT3 mRNA levels were measured by quantitative real-time PCR. Human STAT3 primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 18. As illustrated in Table 18, STAT3 mRNA levels were significantly reduced in a dose-dependent manner in antisense oligonucleotide treated cells.

TABLE 18

Dose-dependent antisense inhibition of human STAT3 in HuVEC cells

| ISIS No | 39.1 nM | 156.3 nM | 625.0 nM | 2500.0 nM | $IC_{50}$ (µM) |
|---|---|---|---|---|---|
| 481464 | 41 | 78 | 92 | 91 | 0.04 |
| 529962 | 30 | 51 | 86 | 95 | 0.12 |
| 529979 | 0 | 43 | 81 | 95 | 0.27 |
| 529982 | 0 | 0 | 70 | 90 | 0.56 |
| 529983 | 31 | 67 | 87 | 94 | 0.08 |
| 529984 | 17 | 44 | 83 | 97 | 0.19 |
| 529999 | 29 | 51 | 83 | 96 | 0.13 |
| 530006 | 18 | 38 | 77 | 94 | 0.22 |
| 530020 | 2 | 39 | 75 | 92 | 0.28 |

Example 17

Effect of ISIS Antisense Oligonucleotides Targeting STAT3 in the Treatment of an MDA-MB-231 Human Breast Cancer Xenograft Model BALB/c nude mice inoculated with human breast cancer cells MDA-MB-231 were treated with ISIS 481464 and ISIS 481549. ISIS 481549 is cross-reactive with the mouse sequence (i.e, hybridizes to the mouse sequence). Tumor growth and tolerability of oligonucleotides in the mice was evaluated.

Treatment

The study was conducted at Pharmaron Inc (Beijing, P.R. China). The BALB/c nude mice were obtained from Beijing HFK Bio-Technology Co., Ltd. MDA-MB-231 human breast cancer cells were maintained in vitro as a monolayer culture in Leibovitz's L-15 medium supplemented with 10% heat-inactivated fetal calf serum, 100 U/mL penicillin, 100 μg/mL streptomycin, and 2 mM L-glutamine. The cells were maintained at 37° C. in an atmosphere of 5% $CO_2$ in air. The tumor cells were routinely sub-cultured twice weekly with trypsin-EDTA treatment. Cells growing at exponential growth phase were harvested and counted for tumor inoculation.

Three groups of eight randomly assigned 6-8 week-old female BALB/c nude mice each were inoculated in the right flank with the MDA-MB-231 tumor fragments (3 mm×2 mm×2 mm, which were generated from tumor inoculation passage) for tumor development. Antisense oligonucleotide treatment started at day 11 after tumor inoculation when the mean tumor size reached approximately 100 $mm^3$. Two of the groups were injected intraperitoneally twice a week for 3 weeks with 25 mg/kg of ISIS 481464 or ISIS 481549. A control group of mice was injected intraperitoneally twice a week for 3 weeks with PBS.

All procedures related to animal handling, care, and treatment, were performed according to the guidelines approved by the Institutional Animal Care and Use Committee (IACUC). Animals were routinely checked for any effects of tumor growth on normal behavior, such as mobility, food consumption, body weight changes, and any other abnormal effect.

RNA Analysis

RNA was extracted from tumor tissue for real-time PCR analysis of human STAT3 mRNA levels using primer probe set RTS199, described hereinabove. Murine STAT3 mRNA levels were also measured using primer probe set mSTAT3_LTS00664 (forward sequence CGACAGCTTC-CCCATGGA, designated herein as SEQ ID NO: 1513; reverse sequence ATGCCCAGTCTTGACTCTCAATC, designated herein as SEQ ID NO: 1514; probe sequence CTGCGGCAGTTCCTGGCACCTT, designated herein as SEQ ID NO: 1515). Results are presented as percent inhibition of STAT3, relative to PBS control, normalized to cyclophilin. As shown in Table 19, treatment with ISIS antisense oligonucleotides resulted in reduction of both human and murine STAT3 mRNA in comparison to the PBS control.

TABLE 19

Percent inhibition of STAT3 mRNA in the treatment groups relative to the PBS control in the MDA-MB-231 xenograft model

| ISIS No | human STAT3 | murine STAT3 |
|---|---|---|
| 481464 | 25 | 16 |
| 481549 | 22 | 44 |

Effect on Tumor Growth

Tumor size was measured twice weekly in two dimensions using a caliper. Tumor volumes were calculated using the formula: $V=0.536 \times a \times b^2$, where a and b are the long and short diameters of the tumor, respectively. The tumor size was utilized for calculations of the T-C and $T_V/C_V$ values. T-C was calculated with T as the median time (in days) required for the tumors in the treatment groups to reach a pre-determined size (900 $mm^3$), and C as the median time (in days) for the tumors in the control group to reach the same size. The $T_V/C_V$ value (expressed as percentage) is an indication of the anti-tumor effectiveness of the ISIS oligonucleotides, where $T_V$ and $C_V$ were the mean volume of the treated and control groups, respectively, on a given day (day 32).

The results are presented in Tables 20 and 21. The data indicates that treatment with ISIS 481464 and ISIS 481549 significantly impeded tumor growth.

TABLE 20

Effect of antisense inhibition of STAT3 on tumor growth in the MDA-MB-231 xenograft model

| Day | PBS | ISIS 481464 | ISIS 481549 |
|---|---|---|---|
| 11 | 103 | 104 | 104 |
| 15 | 185 | 142 | 158 |
| 18 | 292 | 200 | 205 |
| 22 | 519 | 305 | 326 |
| 25 | 745 | 430 | 436 |
| 29 | 1,332 | 643 | 688 |
| 32 | 1,741 | 921 | 984 |

TABLE 21

Effect of antisense inhibition of STAT3 on tumor growth inhibition in the MDA-MB-231 xenograft model

| Treatment | Tumor Size ($mm^3$) at day 32 | $T_V/C_V$ (%) | T-C at 900 $mm^3$ |
|---|---|---|---|
| PBS | 1,741 | — | — |
| ISIS 481464 | 921 | 53 | 6 |
| ISIS 481549 | 984 | 57 | 5 |

Body Weight Measurements

To evaluate the effect of ISIS oligonucleotides on the overall health of the animals, body weights were measured on a regular basis during the treatment period. The data is presented in Table 22 and indicate that treatment with either ISIS 481464 or ISIS 481549 does not cause significant weight gain or loss.

TABLE 22

Body weight measurements of mice in the MDA-MB-231 xenograft model

| | Day 11 | Day 15 | Day 18 | Day 22 | Day 25 | Day 29 | Day 32 |
|---|---|---|---|---|---|---|---|
| PBS | 21.8 | 22.2 | 22.5 | 22.5 | 22.9 | 23.4 | 24.0 |
| ISIS 481464 | 22.3 | 22.8 | 23.0 | 23.2 | 23.8 | 23.9 | 24.9 |
| ISIS 481549 | 22.2 | 22.5 | 23.0 | 23.3 | 23.7 | 23.7 | 24.6 |

Example 18

Effect of ISIS Antisense Oligonucleotides Targeting STAT3 in the Treatment of an A431 Human Epidermoid Carcinoma Xenograft Model BALB/c nude mice inoculated with human epidermoid cancer cells A431 were treated with ISIS 481464 and ISIS 481549. ISIS 481549 is cross-reactive with the mouse sequence (i.e, hybridizes to the mouse sequence). The effect of the treatment on tumor growth and tolerability in the mice was evaluated.

Treatment

The study was conducted at Pharmaron Inc (Beijing, P.R. China). The BALB/c nude mice were obtained from Beijing HFK Bio-Technology Co., Ltd. A431 human epidermoid carcinoma cells were maintained in vitro as a monolayer culture in DMEM medium supplemented with 10% heat-inactivated fetal calf serum, 100 U/mL penicillin, 100 μg/mL streptomycin, and 2 mM L-glutamine. The cells were maintained at 37° C. in an atmosphere of 5% $CO_2$ in air. The tumor cells were routinely sub-cultured twice weekly with trypsin-EDTA treatment. Cells growing in an exponential growth phase were harvested and counted for tumor inoculation.

Three groups of eight randomly assigned 6-8 week-old female BALB/c nude mice each were inoculated subcutaneously with $5\times10^6$ A431 tumor cells for tumor development. Antisense oligonucleotide treatment started at day 8 after tumor inoculation when the mean tumor size reached approximately 95 $mm^3$. Two of the groups were injected intraperitoneally twice a week for 4 weeks with 25 mg/kg of ISIS 481464 or ISIS 481549. A control group of mice was injected intraperitoneally twice a week for 4 weeks with PBS.

All procedures related to animal handling, care, and treatment, were performed according to the guidelines approved by the Institutional Animal Care and Use Committee (IACUC). At the time of routine monitoring, the animals were checked for any effects of tumor growth on normal behavior, such as mobility, food consumption, body weight changes and any other abnormal effect.

RNA Analysis

RNA was extracted from tumor tissue for real-time PCR analysis of human STAT3 mRNA levels using primer probe set RTS199, described hereinabove. Murine STAT3 mRNA levels were also measured using primer probe set mSTAT3_LTS00664, described hereinabove. Results are presented as percent inhibition of STAT3, relative to PBS control, normalized to cyclophilin. As shown in Table 23, treatment with ISIS antisense oligonucleotides resulted in reduction of both human and murine STAT3 mRNA in comparison to the PBS control.

TABLE 23

Inhibition of STAT3 mRNA in the treatment groups relative to the PBS control in the A431 xenograft model

| ISIS No | human STAT3 | murine STAT3 |
|---|---|---|
| 481464 | 63 | 26 |
| 481549 | 29 | 38 |

Protein Analysis

Protein was extracted from tumor lysates for western analysis of human STAT3 protein levels with STAT3 monoclonal antibody (Cell Signaling Technology, Cat #9135). Results are presented as percent inhibition of STAT3, relative to PBS control, normalized to the house-keeping protein, COX-II. As shown in Table 24, treatment with ISIS antisense oligonucleotides resulted in reduction of STAT3 protein levels in comparison to the PBS control.

TABLE 24

Inhibition of STAT3 protein levels in the treatment groups relative to the PBS control in the A431 xenograft model

| ISIS No | % reduction |
|---|---|
| 481464 | 99 |
| 481549 | 22 |

Effect on Tumor Growth

Tumor size was measured twice weekly in two dimensions using a caliper, and tumor volumes were calculated using the formula: $V=0.5\times a\times b^2$, where a and b are the long and short diameters of the tumor, respectively. The tumor size was utilized for calculations of the T-C and $T_V/C_V$ values. T-C was calculated with T as the median time (in days) required for the tumors in the treatment groups to reach a pre-determined size (800 $mm^3$), and C as the median time (in days) for the tumors in the control group to reach the same size. The $T_V/C_V$ value (expressed as percentage) is an indication of the anti-tumor effectiveness of the ISIS oligonucleotides, where $T_V$ and $C_V$ were the mean volume of the treated and control groups, respectively, on a given day (day 33).

The results are presented in Tables 25 and 26. The data indicates that treatment with either ISIS 481464 or ISIS 481549 significantly impeded tumor growth.

TABLE 25

Effect of antisense inhibition of STAT3 on tumor growth in the A431 xenograft model

| Days | PBS | ISIS 481464 | ISIS 481549 |
|---|---|---|---|
| 8 | 94 | 95 | 95 |
| 14 | 178 | 157 | 132 |
| 17 | 308 | 261 | 202 |
| 21 | 528 | 412 | 304 |
| 24 | 682 | 552 | 426 |
| 28 | 875 | 698 | 555 |
| 31 | 1,071 | 898 | 716 |
| 33 | 1,210 | 1,030 | 858 |

TABLE 26

Effect of antisense inhibition of STAT3 on tumor growth inhibition in the A431 xenograft model

| Treatment | Tumor Size ($mm^3$) at day 33 | $T_V/C_V$ (%) | T-C at 800 $mm^3$ |
|---|---|---|---|
| PBS | 1,210 | — | — |
| ISIS 481464 | 1,030 | 85 | 3 |
| ISIS 481549 | 858 | 71 | 6 |

Body Weight Measurements

To evaluate the effect of ISIS oligonucleotides on the overall health of the animals, body weights were measured on a regular basis during the treatment period. The data is presented in Table 27 and indicate that treatment with either ISIS 481464 or ISIS 481549 does not affect the overall health of the mice.

TABLE 27

Body weight measurements of mice in the A431 xenograft model

| | Day 8 | Day 14 | Day 17 | Day 21 | Day 24 | Day 28 | Day 31 | Day 33 |
|---|---|---|---|---|---|---|---|---|
| PBS | 20 | 20 | 20 | 21 | 21 | 21 | 22 | 22 |
| ISIS 481464 | 20 | 21 | 21 | 21 | 21 | 22 | 22 | 23 |
| ISIS 481549 | 20 | 20 | 21 | 21 | 21 | 22 | 22 | 22 |

Example 19

Effect of ISIS Antisense Oligonucleotides Targeting STAT3 in the Treatment of an NCI-H460 Human Non-Small Cell Lung Cancer (NSCLC) Xenograft Model BALB/c nude mice inoculated with human NCI-H460 human NSCLC were treated with ISIS 491464, which targets human STAT3, and ISIS 481549, which targets both human and murine STAT3. The effect of the treatment on tumor growth and tolerability in the mice was evaluated.

Treatment

The study was conducted at Pharmaron Inc (Beijing, P.R. China). The BALB/c nude mice were obtained from Beijing HFK Bio-Technology Co., Ltd. NCI-H460 human NSCLC cells were maintained in vitro as a monolayer culture in RPMI-1640 medium supplemented with 10% heat-inactivated fetal calf serum, 100 U/mL penicillin, 100 µg/mL streptomycin, and 2 mM L-glutamine. The cells were maintained at 37° C. in an atmosphere of 5% $CO_2$ in air. The tumor cells were routinely sub-cultured twice weekly with trypsin-EDTA treatment. Cells growing in an exponential growth phase were harvested and counted for tumor inoculation.

Three groups of eight randomly assigned 6-8 week-old female BALB/c nude mice each were inoculated subcutaneously with $2\times10^6$ NCI-H460 tumor cells for tumor development. Antisense oligonucleotide treatment started at day 6 after tumor inoculation when the mean tumor size reached approximately 100 $mm^3$. Two of the groups were injected intraperitoneally twice a week for 3 weeks with 25 mg/kg of ISIS 481464 or ISIS 481549. The third group of mice was injected intraperitoneally twice a week for 3 weeks with PBS, and served as the control group.

All procedures related to animal handling, care, and treatment, were performed according to the guidelines approved by the Institutional Animal Care and Use Committee (IACUC). At the time of routine monitoring, the animals were checked for any effects of tumor growth on normal behavior, such as mobility, food consumption, body weight changes and any other abnormal effect.

RNA Analysis

RNA was extracted from tumor tissue for real-time PCR analysis of human STAT3 mRNA levels using primer probe set RTS199, described hereinabove. Murine STAT3 mRNA levels were also measured using primer probe set mSTAT3_LTS00664, described hereinabove. Results are presented as percent inhibition of STAT3, relative to PBS control, normalized to cyclophilin. As shown in Table 28, treatment with ISIS antisense oligonucleotides resulted in reduction of both human and murine STAT3 mRNA in comparison to the PBS control.

TABLE 28

Inhibition of STAT3 mRNA in the treatment groups relative to the PBS control in the NCI-H460 xenograft model

| ISIS No | human STAT3 | murine STAT3 |
|---|---|---|
| 481464 | 34 | 0 |
| 481549 | 20 | 35 |

Effect on Tumor Growth

Tumor size was measured twice weekly in two dimensions using a caliper, and tumor volumes were calculated using the formula: $V=0.5\times a\times b^2$, where a and b are the long and short diameters of the tumor, respectively. The tumor size was utilized for calculations of the T-C and $T_V/C_V$ values. T-C was calculated with T as the median time (in days) required for the tumors in the treatment groups to reach a pre-determined size (1,500 $mm^3$), and C as the median time (in days) for the tumors in the control group to reach the same size. The $T_V/C_V$ value (expressed as percentage) is an indication of the anti-tumor effectiveness of the ISIS oligonucleotides, where $T_V$ and $C_V$ were the mean volume of the treated and control groups, respectively, on a given day (day 20).

The results are presented in Tables 29 and 30. The data indicates that treatment with either ISIS 481464 or ISIS 481549 significantly impeded tumor growth.

TABLE 29

Effect of antisense inhibition of STAT3 on tumor growth in the NCI-H460 xenograft model

| Days | PBS | ISIS 481464 | ISIS 481549 |
|---|---|---|---|
| 6 | 104 | 104 | 103 |
| 8 | 303 | 197 | 197 |
| 11 | 746 | 498 | 443 |
| 13 | 1,175 | 676 | 654 |
| 15 | 1,642 | 982 | 954 |
| 18 | 2,277 | 1,571 | 1,577 |
| 20 | 2,859 | 1,996 | 2,093 |
| 22 | — | 2,609 | 2,679 |

TABLE 30

Effect of antisense inhibition of STAT3 on tumor growth inhibition in the NCI-H460 xenograft model

| Treatment | Tumor Size ($mm^3$) at day 20 | $T_V/C_V$ (%) | T-C at 1,500 $mm^3$ |
|---|---|---|---|
| PBS | 1,210 | — | — |
| ISIS 481464 | 1,030 | 85 | 3 |
| ISIS 481549 | 858 | 71 | 6 |

Body Weight Measurements

To evaluate the effect of ISIS oligonucleotides on the overall health of the animals, body weights were measured on a regular basis during the treatment period. The data is presented in Table 31 and indicate that treatment with either ISIS 481464 or ISIS 481549 does not affect the overall health of the mice.

TABLE 31

Body weight measurements of mice in the NCI-H460 xenograft model

| | Day 6 | Day 8 | Day 11 | Day 13 | Day 15 | Day 18 | Day 20 | Day 22 |
|---|---|---|---|---|---|---|---|---|
| PBS | 20 | 20 | 20 | 20 | 20 | 20 | 21 | — |
| ISIS 481464 | 20 | 20 | 20 | 20 | 19 | 19 | 20 | 20 |
| ISIS 481549 | 20 | 20 | 20 | 20 | 20 | 19 | 20 | 20 |

Example 20

Effect of Antisense Inhibition of Human STAT3 in a Human Glioblastoma Orthotopic Mouse Model NU/J mice orthotopically implanted with human glioblastoma cells were treated with ISIS 455291, a 5-10-5 MOE gapmer having a sequence of CAGCAGATCAAGTC-CAGGGA (SEQ ID NO: 1590). The effect of the treatment on tumor growth and tolerability in the mice was evaluated.

Treatment

Thirty NU/J mice were stereotactically implanted in the right frontal lobe with $5\times10^5$ U-87 MG-luc2 cells. On day 15 after tumor cell implantation, 15 of these mice were dosed intracranially with a bolus injection at the site of tumor implantation with 100 µg of ISIS 455291, which was dissolved in 2 µL of PBS. The remaining 15 mice were dosed intracranially with a bolus injection at the site of tumor implantation with 2 µL of PBS. The second group of mice served as the control group.

Analysis

On day 18 after tumor transplantation, five mice from each group were euthanized by $CO_2$ inhalation and brain samples were collected for RNA analysis. RNA was extracted from tumor tissue for real-time PCR analysis of human STAT3 mRNA levels using primer probe set RTS199, described hereinabove. Treatment with ISIS 455291 resulted in 27% reduction of human STAT3 mRNA in the tumor tissue in comparison to the PBS control.

The remaining mice in each group were monitored regularly up to 2 weeks for survival analysis. The median survival for the PBS control group was 30.5 days. The medial survival for the ISIS oligonucleotide-treated mice was 35 days. The P value was 0.2088.

Example 21

Effect of Treatment with ISIS 481549 in APC/Min$^+$ Mice

The effect of treatment with ISIS 481549 on STAT3 mRNA levels and intestinal adenoma numbers in the APC/Min$^+$ mouse model was evaluated. The APC/Min$^+$ mice strain is predisposed to spontaneous intestinal adenoma formation throughout the entire intestinal tract at an early age (Moser A. R. et al., Science 1990. 247: 322-324).

Treatment

Two groups of 4 male nine-week-old APC/Min+ mice were injected subcutaneously with 5 mg/kg or 25 mg/kg of ISIS 481549 administered five times a week (total weekly doses of 25 mg/kg and 125 mg/kg, respectively) for 4 weeks. A group of 4 male nine-week-old APC/Min+ mice were injected subcutaneously with 50 mg/kg of control oligonucleotide, ISIS141923, administered five times a week (total weekly dose of 250 mg/kg) for 4 weeks. A control group of 4 male nine-week-old APC/Min+ mice were injected subcutaneously with PBS administered five times a week for 4 weeks. Mice were euthanized with isoflurane followed by cervical dislocation 48 hrs after the final injection.

Colons and intestines were removed, separated from each other and cleaned. Approximately 5 cm of the upper intestinal tract was excised and homogenized in 2.5 mL RLT buffer (Qiagen) with 1% of 2-mercaptoethanol (RLT-BMe) and placed in dry ice. The colon was cut in half and the proximal half of the tissue was homogenized in 2.5 mL RLT-BMe and placed in dry ice. A small piece of the liver (0.2 g) was excised and homogenized in RLT-BMe and placed in dry ice.

RNA Analysis

RNA was isolated from the tissues using PureLink™ Total RNA Purification kit (Invitrogen; #12173-011A), according to the manufacturer's protocol. RT-PCR was performed using the StepOnePlus system (Applied Biosystems), according to the manufacturer's protocol. Murine primer probe set mSTAT3_LTS000664 (forward primer CGACAGCTTC-CCCATGGA, designated herein as SEQ ID NO: 1513; reverse primer ATGCCCAGTCTTGACTCTCAATC, designated herein as SEQ ID NO: 1514; probe CTGCGGCAGT-TCCTGGCACCTT, designated herein as SEQ ID NO: 1515) was used for measuring STAT3 mRNA levels. The mRNA level of the housekeeping gene, Cyclophilin, was measured with the primer probe set mcyclo_24 (forward primer TCGCCGCTTGCTGCA, designated herein as SEQ ID NO: 1516; reverse primer ATCGGCCGTGATGTCGA, designated herein as SEQ ID NO: 1517; probe CCATGGTCAAC-CCCACCGTGTTC, designated herein as SEQ ID NO: 1518) and was used to normalize STAT3 mRNA levels.

Treatment with ISIS 481549 resulted in statistically significant reduction in STAT3 mRNA expression in liver at 25 mg/kg/wk and 125 mg/kg/wk dosing in liver, small intestine and colon (Table 32) compared to the PBS control. Significant differences between the treatment and the control groups were determined using the Student's two-tailed t test ($p<0.05$).

TABLE 32

Percent inhibition of STAT3 mRNA expression levels in APC/Min+ mice

| Treatment (mg/kg/week) | Liver | Small intestine | Colon |
| --- | --- | --- | --- |
| ISIS 141923 (250) | 0 | 0 | 0 |
| ISIS 481549 (125) | 98 | 73 | 82 |
| ISIS 481549 (25) | 79 | 41 | 32 |

Adenoma Number Analysis

Histological analysis of the small intestine was performed to microscopically evaluate adenoma numbers. Treatment with ISIS 481549 at 125 mg/kg/week resulted in a statistically significant decrease in tumor number compared to the PBS control (Table 33). Significant differences between the treatment and the control groups were determined using the Student's two-tailed t test ($p<0.05$).

TABLE 33

Adenoma counts in APC/Min+ mice

| Treatment (mg/kg/week) | Colon count |
| --- | --- |
| ISIS 141923 (250) | 5 |
| ISIS 481549 (125) | 1 |
| ISIS 481549 (25) | 5 |
| PBS | 6 |

Example 22

Effect of Antisense Oligonucleotides Targeting STAT3 in the Treatment of a PC-9 NSCLC Xenograft Model BALB/c nude mice (Charles River) inoculated with the human non-small cell lung cancer cell line, PC-9, were treated with ISIS 481549 and ISIS 481464. Tumor growth and STAT3 target reduction in the mice were evaluated.

Treatment

Six- to eight-week old female BALB/c nude mice were inoculated subcutaneously with $7 \times 10^6$ PC-9 human NSCLC cells. Mice that displayed a mean tumor volume of 150-200 mm$^3$ were selected and randomized into different treatment groups. Two groups of 7 mice were injected subcutaneously with 25 mg/kg of ISIS 481549 or ISIS 481464 administered five times a week (total weekly doses of 125 mg/kg) for 6 weeks. A group of 7 mice were injected subcutaneously with 25 mg/kg of ISIS 347526 (TCTTATGTTTCCGAACCGTT, no known murine or human target, designated herein as SEQ ID NO: 1519) administered five times a week (total weekly doses of 125 mg/kg) for 6 weeks. A final dose of antisense oligonucleotide was given 24 hrs before the mice were euthanized.

RNA Analysis

Tumors were harvested and RNA was isolated using Qiagen RNAeasy Mini Kit (#74106), according to the manufacturer's protocol. STAT3 mRNA levels were measured using an ABI StepOnePlus RT-PCR instrument with human STAT3 primer probe set RTS2033 (forward primer GAGGC-CCGCCCAACA, designated herein as SEQ ID NO: 1520; reverse primer TTCTGCTAATGACGTTATCCAGTTTT, designated herein as SEQ ID NO: 1521; probe CTGCCTA-GATCGGC, designated herein as SEQ ID NO: 1522). The mRNA levels of the housekeeping gene, GAPDH, was measured with the human primer probe set (forward primer GAAGGTGAAGGTCGGAGTC, designated herein as SEQ ID NO: 1523; reverse primer GAAGATGGTGATGG-GATTTC, designated herein as SEQ ID NO: 1524; probe CAAGCTTCCCGTTCTCAGCC, designated herein as SEQ ID NO: 1525) and was used to normalize RNA levels. The results are presented in Table 34 and indicate that the antisense oligonucleotides reduced STAT3 mRNA levels.

TABLE 34

Percent inhibition of STAT3 mRNA expression levels in the NSCLC xenograft model compared to the ASO control

| Treatment (mg/kg) | % inhibition |
|---|---|
| ISIS 481464 (25) | 40 |
| ISIS 481549 (25) | 22 |

Tumor Growth Analysis

Tumors were measured regularly throughout the study period. Tumor growth inhibition (TGI) was calculated using the formula TGI=[1−(X of STAT3 ASO group (final))−X of STAT3 ASO group (day1))/(X of control ASO group (final)−X of control ASO group (day1))]× 100%, where X=mean tumor volume.

The difference of the treatment group from the control group was evaluated using the ANOVA statistical test. The results are presented in Table 35. The data indicates that tumor growth was significantly inhibited by ISIS 481464 with TGI of 97% by day 52. Treatment by ISIS 481549 inhibited PC-9 tumor growth by 78%.

Example 23

Effect of ISIS 481464 in the Treatment of an LG-476 NSCLC Xenograft Model

NOD.Cg-Prkdc$^{scid}$ Il2rg$^{tm1Wjl}$/SzJ mice (NSG; JAX #5557), which are immunodeficient, were inoculated with the human non-small cell lung cancer cell line, LG-476 (Jackson Laboratory) and treated with ISIS 481464. Tumor growth and STAT3 target reduction in the mice was evaluated.

Treatment

Four- to six-week old female NSG mice were inoculated subcutaneously with LG-476 human NSCLC cells and monitored three times weekly for clinical observations, body weights and tumor volume. Once tumors reached 1,000 mm$^3$, the tumors were harvested and fragmented. Tumor fragments measuring 3-5 mm$^3$ were implanted subcutaneously into the right hind flank of 30 NSG mice. The mice were monitored three times a week. When individual tumors reached a volume of 200-250 mm$^3$, the mice were randomly assigned to 2 groups and were injected with 25 mg/kg of ISIS 481464 or PBS administered 5 times a week (weekly doses of 125 mg/kg) for 3 weeks. Tumors were harvested 24 hrs after the last dose.

RNA Analysis

Lysates from tumors were prepared using an ABI StepOne-Plus RT-PCR instrument with a human-specific primer probe set RTS2033. The mRNA levels of the housekeeping gene, Cyclophilin, was measured with a human-specific primer probe set (forward primer GACGGCGAGCCCTTGG, designated herein as SEQ ID NO: 1526; reverse primer TGCT-GTCTTTGGGACCTTGTC, designated herein as SEQ ID NO: 1527; probe CCGCGTCTCCTTTGAGCTGTTTGC, designated herein as SEQ ID NO: 1528). Significant differences between the treatment and the control groups were determined using the Student's two-tailed t test (p<0.05).

Treatment with ISIS 481464 resulted in 43% reduction of STAT3 mRNA levels in the tumor mass compared to the PBS control, which is statistically significant.

TABLE 35

Tumor growth measurements in the NSCLC xenograft model

| Day | 10 | 13 | 18 | 20 | 25 | 28 | 31 | 34 | 38 | 42 | 45 | 48 | 52 |
|---|---|---|---|---|---|---|---|---|---|---|---|---|---|
| ISIS 481464 | 233 | 241 | 267 | 240 | 229 | 201 | 201 | 254 | 218 | 222 | 221 | 236 | 255 |
| ISIS 481549 | 233 | 217 | 239 | 188 | 237 | 299 | 326 | 318 | 328 | 410 | 341 | 389 | 398 |
| ISIS 347526 | 240 | 279 | 295 | 344 | 295 | 354 | 383 | 407 | 540 | 573 | 655 | 890 | 940 |

Body Weight Analysis

Body weights were measured regularly throughout the study period. The results are presented in Table 36 and indicate that there were no significant changes in body weight of the treatment groups compared to the control groups.

Protein Analysis

Total cell lysates were prepared by homogenizing tumor in ice-cold radio-immunoprecipitation assay (RIPA) buffer containing protease inhibitor cocktail. The lysates were analyzed by western blotting using STAT3 antibody (Abeam Antibod-

TABLE 36

Body weight measurements in the NSCLC xenograft model

| Day | 10 | 13 | 18 | 20 | 25 | 28 | 31 | 34 | 38 | 42 | 45 | 48 | 52 |
|---|---|---|---|---|---|---|---|---|---|---|---|---|---|
| ISIS 481464 | 18.65 | 19.44 | 18.98 | 19.66 | 19.40 | 19.45 | 19.89 | 20.26 | 19.86 | 20.31 | 20.13 | 20.03 | 20.11 |
| ISIS 481549 | 18.13 | 19.06 | 18.65 | 19.30 | 19.31 | 19.36 | 19.23 | 19.18 | 18.28 | 17.21 | 16.49 | 15.48 | 15.01 |
| ISIS 347526 | 18.34 | 19.29 | 19.05 | 19.65 | 19.63 | 19.98 | 20.08 | 20.69 | 19.90 | 20.19 | 20.25 | 20.09 | 20.19 | ies, #ab32500). The house-keeping proteins, cytochrome oxidase II (COXII; #ab79393) and survivin (#ab76424) were also probed. STAT3 levels were normalized to either COXII protein or survivin protein and quantified using ImageJ software.

Treatment with ISIS 481464 resulted in 50% reduction in STAT3 protein levels in the tumor mass compared to the PBS control, which is statistically significant.

Tumor Growth Analysis

Tumors were measured regularly throughout the study period. Treatment with ISIS 481464 resulted in decrease in tumor volume of approximately 39% compared to the PBS control.

Example 24

Dose-Dependent Antisense Inhibition of STAT3 Following Free Uptake of Antisense Oligonucleotide in PC9 Cells ISIS 481464, from the studies described above, was further tested at different doses in PC9 cells, a non small cell lung carcinoma cell line. Cells were plated at a density of 3,000 cells per well. Cells were incubated with 0.02 µM, 0.1 µM, 0.5 µM, 2.5 µM, and 10.0 µM concentrations of antisense oligonucleotide, as specified in Table 37. After approximately 24 hours, RNA was isolated from the cells and STAT3 mRNA levels were measured by quantitative real-time PCR. Human STAT3 primer probe set RTS2033 (forward sequence GAGGCCCGCCCAACA, designated herein as SEQ ID NO: 1520; reverse sequence TTCTGCTAATGACGTTATCCAGTTTT, designated herein as SEQ ID NO: 1521; probe sequence CTGCCTAGATCGGC, designated herein as SEQ ID NO: 1522) was used to measure mRNA levels. STAT3 mRNA levels were adjusted according to content of beta-actin, a housekeeping gene, as measured by human primer probe set HTS5002 (forward sequence CGGACTATGACTTAGTTGCGTTACA, designated herein as SEQ ID NO: 1529; reverse sequence GCCATGCCAATCTCATCTTGT, designated herein as SEQ ID NO: 1530; probe sequence CCTTTCTTGACAAAACCTAACTTGCGCAGA, designated herein as SEQ ID NO: 1531). Results are presented as percent inhibition of STAT3, relative to untreated control cells.

The half maximal inhibitory concentration ($IC_{50}$) of each oligonucleotide is also presented in Table 37. As illustrated in Table 37, ISIS 481464 was able to penetrate the cell membrane.

TABLE 37

Dose-dependent antisense inhibition of STAT3 mRNA levels by free-uptake of ISIS oligonucleotide by PC9 cells

| ISIS No | 0.02 µM | 0.1 µM | 0.5 µM | 2.5 µM | 10.0 µM | $IC_{50}$ (µM) |
|---|---|---|---|---|---|---|
| 481464 | 20 | 51 | 84 | 94 | 96 | 0.19 |

Example 25

Dose-Dependent Antisense Inhibition of STAT3 Following Free Uptake of Antisense Oligonucleotide in C42B Cells ISIS 481464, from the studies described above, was further tested at different doses in C42B cells, a prostate cancer cell line. Cells were plated at a density of 3,000 cells per well. Cells were incubated with 0.02 µM, 0.1 µM, 0.5 µM, 2.5 µM, and 10.0 µM concentrations of antisense oligonucleotide, as specified in Table 38. After approximately 24 hours, RNA was isolated from the cells and STAT3 mRNA levels were measured by quantitative real-time PCR. Human STAT3 primer probe set RTS2033 (forward sequence GAGGCCCGCCCAACA, designated herein as SEQ ID NO: 1520; reverse sequence TTCTGCTAATGACGTTATCCAGTTTT, designated herein as SEQ ID NO: 1521; probe sequence CTGCCTAGATCGGC, designated herein as SEQ ID NO: 1522) was used to measure mRNA levels. STAT3 mRNA levels were adjusted according to content of beta-actin, a housekeeping gene, as measured by human primer probe set HTS5002 (forward sequence CGGACTATGACTTAGTTGCGTTACA, designated herein as SEQ ID NO: 1529; reverse sequence GCCATGCCAATCTCATCTTGT, designated herein as SEQ ID NO: 1530; probe sequence CCTTTCTTGACAAAACCTAACTTGCGCAGA, designated herein as SEQ ID NO: 1531). Results are presented as percent inhibition of STAT3, relative to untreated control cells.

The half maximal inhibitory concentration ($IC_{50}$) of each oligonucleotide is also presented in Table 38. As illustrated in Table 38, ISIS 481464 was able to penetrate the cell membrane.

TABLE 38

Dose-dependent antisense inhibition of STAT3 mRNA levels by free-uptake of ISIS oligonucleotide by C42B cells

| ISIS No | 0.02 µM | 0.1 µM | 0.5 µM | 2.5 µM | 10.0 µM | $IC_{50}$ (µM) |
|---|---|---|---|---|---|---|
| 481464 | 21 | 38 | 75 | 87 | 96 | 0.45 |

Example 26

Dose-Dependent Antisense Inhibition of STAT3 Following Free Uptake of Antisense Oligonucleotide in Colo201 Cells ISIS 481464, from the studies described above, was further tested at different doses in Colo201 cells, a colorectal cancer cell line. Cells were plated at a density of 3,000 cells per well. Cells were incubated with 0.02 µM, 0.1 µM, 0.5 µM, 2.5 µM, and 10.0 µM concentrations of antisense oligonucleotide, as specified in Table 39. After approximately 24 hours, RNA was isolated from the cells and STAT3 mRNA levels were measured by quantitative real-time PCR. Human STAT3 primer probe set RTS2033 (forward sequence GAGGCCCGCCCAACA, designated herein as SEQ ID NO: 1520; reverse sequence TTCTGCTAATGACGTTATCCAGTTTT, designated herein as SEQ ID NO: 1521; probe sequence CTGCCTAGATCGGC, designated herein as SEQ ID NO: 1522) was used to measure mRNA levels. STAT3 mRNA levels were adjusted according to content of beta-actin, a housekeeping gene, as measured by human primer probe set HTS5002 (forward sequence CGGACTATGACTTAGTTGCGTTACA, designated herein as SEQ ID NO: 1529; reverse sequence GCCATGCCAATCTCATCTTGT, designated herein as SEQ ID NO: 1530; probe sequence CCTTTCTTGACAAAACCTAACTTGCGCAGA, designated herein as SEQ ID NO: 1531). Results are presented as percent inhibition of STAT3, relative to untreated control cells.

The half maximal inhibitory concentration (IC$_{50}$) of each oligonucleotide is also presented in Table 39. As illustrated in Table 39, ISIS 481464 was able to penetrate the cell membrane.

TABLE 39

Dose-dependent antisense inhibition of STAT3 mRNA levels by free-uptake of ISIS oligonucleotide by Colo201 cells

| ISIS No | 0.02 µM | 0.1 µM | 0.5 µM | 2.5 µM | 10.0 µM | IC$_{50}$ (µM) |
|---|---|---|---|---|---|---|
| 481464 | 36 | 53 | 81 | 93 | 96 | 0.09 |

Example 27

Dose-Dependent Antisense Inhibition of STAT3 Following Free Uptake of Antisense Oligonucleotide in BT474M1 Cells ISIS 481464, from the studies described above, was further tested at different doses in BT474M1 cells, a breast cancer cell line. Cells were plated at a density of 3,000 cells per well. Cells were incubated with 0.02mM, 0.1 µM, 0.5 µM, 2.5 µM, and 10.0 µM concentrations of antisense oligonucleotide, as specified in Table 40. After approximately 24 hours, RNA was isolated from the cells and STAT3 mRNA levels were measured by quantitative real-time PCR. Human STAT3 primer probe set RTS2033 (forward sequence GAGGC-CCGCCCAACA, designated herein as SEQ ID NO: 1520; reverse sequence TTCTGCTAATGACGTTATCCAGTTTT, designated herein as SEQ ID NO: 1521; probe sequence CTGCCTAGATCGGC, designated herein as SEQ ID NO: 1522) was used to measure mRNA levels. STAT3 mRNA levels were adjusted according to content of beta-actin, a housekeeping gene, as measured by human primer probe set HTS5002 (forward sequence CGGACTATGACTTAGT-TGCGTTACA, designated herein as SEQ ID NO: 1529; reverse sequence GCCATGCCAATCTCATCTTGT, designated herein as SEQ ID NO: 1530; probe sequence CCTTTCTTGACAAAACCTAACTTGCGCAGA, designated herein as SEQ ID NO: 1531). Results are presented as percent inhibition of STAT3, relative to untreated control cells.

The half maximal inhibitory concentration (IC$_{50}$) of each oligonucleotide is also presented in Table 40. As illustrated in Table 40, ISIS 481464 was able to penetrate the cell membrane.

TABLE 40

Dose-dependent antisense inhibition of STAT3 mRNA levels by free-uptake of ISIS oligonucleotide by BT474M1 cells

| ISIS No | 0.02 µM | 0.1 µM | 0.5 µM | 2.5 µM | 10.0 µM | IC$_{50}$ (µM) |
|---|---|---|---|---|---|---|
| 481464 | 13 | 25 | 74 | 94 | 95 | 0.24 |

Example 28

Dose-Dependent Antisense Inhibition of STAT3 Following Free Uptake of Antisense Oligonucleotide in H929 Cells ISIS 481464, from the studies described above, was further tested at different doses in H929 cells, a multiple myeloma cell line. Cells were plated at a density of 10,000-12,000 cells per well. Cells were incubated with 0.01 µM, 0.5 µM, 2.5 µM, and 10.0 µM concentrations of antisense oligonucleotide, as specified in Table 41. After approximately 72 hours, RNA was isolated from the cells and STAT3 mRNA levels were measured by quantitative real-time PCR. Human STAT3 primer probe set RTS2033 (forward sequence GAGGC-CCGCCCAACA, designated herein as SEQ ID NO: 1520; reverse sequence TTCTGCTAATGACGTTATCCAGTTTT, designated herein as SEQ ID NO: 1521; probe sequence CTGCCTAGATCGGC, designated herein as SEQ ID NO: 1522) was used to measure mRNA levels. STAT3 mRNA levels were adjusted according to content of beta-actin, a housekeeping gene, as measured by human primer probe set HTS5002 (forward sequence CGGACTATGACTTAGT-TGCGTTACA, designated herein as SEQ ID NO: 1529; reverse sequence GCCATGCCAATCTCATCTTGT, designated herein as SEQ ID NO: 1530; probe sequence CCTTTCTTGACAAAACCTAACTTGCGCAGA, designated herein as SEQ ID NO: 1531). Results are presented as percent inhibition of STAT3, relative to untreated control cells.

The half maximal inhibitory concentration (IC$_{50}$) of each oligonucleotide is also presented in Table 41. As illustrated in Table 41, ISIS 481464 was able to penetrate the cell membrane.

TABLE 41

Dose-dependent antisense inhibition of STAT3 mRNA levels by free-uptake of ISIS oligonucleotide by H929 cells

| ISIS No | 0.1 µM | 0.5 µM | 2.5 µM | 10.0 µM | IC$_{50}$ (µM) |
|---|---|---|---|---|---|
| 481464 | 91 | 95 | 95 | 95 | 0.04 |

Example 29

Dose-Dependent Antisense Inhibition of STAT3 Following Free Uptake of Antisense Oligonucleotide in MM1R Cells ISIS 481464, from the studies described above, was further tested at different doses in MFM1R cells, a multiple myeloma cell line. Cells were plated at a density of 10,000-12,000 cells per well. Cells were incubated with 0.01 µM, 0.5 µM, 2.5 µM, and 10.0 µM concentrations of antisense oligonucleotide, as specified in Table 42. After approximately 72 hours, RNA was isolated from the cells and STAT3 mRNA levels were measured by quantitative real-time PCR. Human STAT3 primer probe set RTS2033 (forward sequence GAGGC-CCGCCCAACA, designated herein as SEQ ID NO: 1520; reverse sequence TTCTGCTAATGACGTTATCCAGTTTT, designated herein as SEQ ID NO: 1521; probe sequence CTGCCTAGATCGGC, designated herein as SEQ ID NO: 1522) was used to measure mRNA levels. STAT3 mRNA levels were adjusted according to content of beta-actin, a housekeeping gene, as measured by human primer probe set HTS5002 (forward sequence CGGACTATGACTTAGT-TGCGTTACA, designated herein as SEQ ID NO: 1529; reverse sequence GCCATGCCAATCTCATCTTGT, designated herein as SEQ ID NO: 1530; probe sequence CCTTTCTTGACAAAACCTAACTTGCGCAGA, designated herein as SEQ ID NO: 1531). Results are presented as percent inhibition of STAT3, relative to untreated control cells.

The half maximal inhibitory concentration (IC$_{50}$) of each oligonucleotide is also presented in Table 42. As illustrated in Table 42, ISIS 481464 was able to penetrate the cell membrane.

TABLE 42

Dose-dependent antisense inhibition of STAT3 mRNA levels by free-uptake of ISIS oligonucleotide by MM1R cells

| ISIS No | 0.1 µM | 0.5 µM | 2.5 µM | 10.0 µM | IC$_{50}$ (µM) |
|---|---|---|---|---|---|
| 481464 | 91 | 96 | 95 | 95 | 0.04 |

Example 30

Effect of Antisense Oligonucleotides Targeting STAT3 in the Treatment of an SK-OV3 Ovarian Cancer Xenograft Model BALB/c nude mice were inoculated with the human ovarian cancer cell line, SK-OV3 and treated with ISIS 481464 or ISIS 481549. ISIS 481549 is cross-reactive with the mouse sequence (i.e., hybridizes to the mouse sequence).

Study 1

Human ovarian cancer SK-OV3 cells (approximately 100 mm$^3$) were intraperitoneally injected into nude mice. Ten days later, the mice were inoculated subcutaneously with 25 mg/kg of ISIS 481464 or ISIS 481549, administered twice a week for 11 weeks. The mice were euthanized 24 hrs after the final dose.

RNA Analysis

Lysates were prepared by using the RNA extraction kit (Invitrogen) in for RT-PCR analysis of STAT3 mRNA levels, using human primer probe set (RTS2033) and mouse primer probe set (mSTAT3-LTS0664). The results are presented in Table 43. The results are presented as percent inhibition of STAT3, relative to the PBS control. The data indicates that treatment with ISIS antisense oligonucleotides resulted in reduction of both human and murine STAT3 mRNA in comparison to the PBS control.

TABLE 43

Percent inhibition of STAT3 mRNA in the treatment groups relative to the PBS control in the SK-OV3 xenograft model

| ISIS No | human STAT3 | murine STAT3 |
|---|---|---|
| 481464 | 63 | 0 |
| 481549 | 21 | 61 |

Protein Analysis

Lysates were prepared with RIPA buffer for western blot analysis of STAT3 protein levels, using an antibody against phosphorylated STAT3 (Cell Signaling). The data indicates that treatment with ISIS 481549 resulted in reduction of phosphorylated STAT3 protein in comparison to the PBS control.

IL-6 Level Analysis

Lysates were prepared by using the RNA extraction kit (Invitrogen) for RT-PCR analysis of IL-6 mRNA levels, using mouse primer probe set mIL6-LTS00629. The results are presented in Table 44. The results are presented as percent inhibition of IL-6, relative to the PBS control. The data indicates that treatment with ISIS 481549 resulted in significant reduction of both IL-6 mRNA in comparison to the PBS control.

TABLE 44

Percent inhibition of IL-6 mRNA in the treatment groups relative to the PBS control in the SK-OV3 xenograft model

| ISIS No | Murine IL-6 (%) |
|---|---|
| 481464 | 8 |
| 481549 | 54 |

Tumor Weight Analysis

Tumors were harvested. Tumor weights were measured and the results are presented in Table 45. The results are presented as percent of the PBS control tumor weight. The data indicates that treatment with ISIS 481549 resulted in significant reduction of tumor weight in comparison to the PBS control.

TABLE 45

Percent decrease of tumor weight in the treatment groups relative to the PBS control in the SK-OV3 xenograft model

| ISIS No | Weight (%) |
|---|---|
| 481464 | 58 |
| 481549 | 89 |

Study 2

Human ovarian cancer SK-OV3 cells (approximately 100 mm$^3$) were subcutaneously inoculated into nude mice. Ten days later, the mice were inoculated intraperitoneally with 50 mg/kg of either ISIS 481464 or 50 mg/kg of ISIS 481464 and ISIS 481549 in combination, administered five times a week for 6 weeks. The mice were euthanized 24 hrs after the final dose.

Tumor Volume Analysis

Tumors were measured regularly using Vernier calipers and tumor volumes were calculated using the formula, tumor volume=½ (length× width$^2$). The data indicates that treatment of the mice with a combination of ISIS 481464 and ISIS 481549 resulted in significant inhibition of tumor growth.

Example 31

Tolerability Study of ISIS 481464 in Cynomolgus Monkeys

The efficacy and tolerability of ISIS 481464 in cynomolgus monkeys was evaluated.

Treatment

Male and female naïve cynomolgus monkeys were assigned to five treatment groups. Three groups of 5 monkeys each received loading doses of 3 mg/kg, 10 mg/kg or 30 mg/kg every two days during the first week of the study (on Days 1, 3, 5 and 7) followed by once weekly administration thereafter (commencing on Day 14). A control group of 5 monkeys received PBS every two days during the first week of the study (on Days 1, 3, 5 and 7) as the loading dose, followed by once weekly administration thereafter (commencing on Day 14). These doses were administered via a one-hour intravenous (i.v.) infusion. A fifth group of 5 monkeys received loading doses of 30 mg/kg administered subcutaneously every two days during the first week of the study (on Days 1, 3, 5 and 7) followed by once weekly subcutaneous (s.c.) administration thereafter (commencing on Day 14).

For the i.v. infusions, the animals were restrained, without sedation, to a chair restraint. A catheter was placed in one of the cephalic veins and ISIS 481464 solution at the appropriate dose was infused at a constant rate over approximately 1 hour using a calibrated syringe pump (Stoelting Co, USA). The dosing site was rotated between right and left arms and the dosing time was recorded. The infusion rate was selected to deliver the calculated dose volume and the accuracy of the pumps was monitored and recorded for each dose. At the end of infusion period, the dosing solution was switched to PBS. In case of s.c. administration, the injections were performed in clock-wise rotation at 4 sites on the back. Injection sites were maintained by periodic shaving and permanently numbered by tattooing.

Three monkeys from each group were sacrificed on day 44, which was approximately 48 hrs following the last dose on day 42. The other 2 monkeys from each group are being observed for toxicological effects. Scheduled euthanasia of the animals was conducted by exsanguination after ketamine/xylazine-induced anesthesia and administration of sodium pentobarbital. The protocols described in the Example were approved by the Institutional Animal Care and Use Committee (IACUC).

RATA Analysis

Liver tissue was homogenized in 3 mL of RLT lysis buffer (Qiagen) supplemented with 1% of 2-mercaptoethanol (Sigma). RNA was purified from the resulting homogenate using Qiagen RNeasy 96-well plate for RNA purification, according to the manufacturer's protocol. After purification, the RNA samples were subjected to RT-PCR analysis using Perkin-Elmer ABI Prism 7700 Sequence Detection System and STAT3 primer probe set RTS3235 (forward primer AAGTTTATCTGTGTGACACCAACGA, designated herein as SEQ ID NO: 1532; reverse primer CTTCACCAT-TATTTCCAAACTGCAT, designated herein as SEQ ID NO: 1533; probe TGCCGATGTCCCCCCGCA, designated herein as SEQ ID NO: 1534). STAT3 mRNA levels were normalized to monkey CyclophilinA, which was quantitated using primer probe set mk_cycloA_$2^{nd}$ (forward primer TGCTGGACCCAACACAAATG, designated herein as SEQ ID NO: 1535; reverse primer TGCCATCCAACCACT-CAGTC, designated herein as SEQ ID NO: 1536; probe TTCCCAGTTTTTCATCTGCACTGCCAX, designated herein as SEQ ID NO: 1537).

Treatment with ISIS 481464 at 30 mg/kg dose concentrations either via i.v. infusion or s.c. injection resulted in statistically significant reduction in STAT3 mRNA expression in liver (Table 46) compared to the PBS control. Significant differences between the treatment and the control groups were determined using the Student's t test (p<0.05).

TABLE 46

Percent inhibition of STAT3 mRNA levels in cynomolgus monkeys

| Treatment | % inhibition |
| --- | --- |
| 3 mg i.v. | 0 |
| 10 mg i.v. | 7 |
| 30 mg i.v. | 52 |
| 30 mg s.c. | 51 |

Protein Analysis

Liver tissue was homogenized in 1 mL of ice-cold RIPA buffer (Sigma) containing inhibitor cocktails of both proteases and phosphatases (Roche). Total lysates were separated by Bis-Tris PAGE (Invitrogen), transferred to a PVDF membrane, and immunoblotted using primary antibodies for STAT3 (Cell Signaling, #9132) and GAPDH (Advanced Immunochemicals, #06-1-G4-05). Immunospecific bands were detected with the Enhanced Chemiluminescence Plus detection kit (Amersham Biosciences) after exposure to X-ray film. The intensity of the bands was then scanned and quantified using ImageJ software. Significant differences between the treatment and the control groups were determined using the Student's t test (p<0.05).

There was a dose-dependent decrease in STAT3 protein levels, as shown in Table 47, with 33% and 82% reduction at 3 mg/kg/week and 10 mg/kg/week respectively. STAT3 protein was undetectable at 30 mg/kg/week irrespective of the dosing route.

TABLE 47

Percent inhibition of STAT3 protein levels in cynomolgus monkeys

| Treatment | % inhibition |
| --- | --- |
| 3 mg i.v. | 33 |
| 10 mg i.v. | 82 |
| 30 mg i.v. | 100 |
| 30 mg s.c. | 100 |

Liver Function

To evaluate the effect of ISIS oligonucleotides on hepatic function, blood samples were collected from all the study groups. The blood samples were collected via femoral venipuncture on day 44, 48 hrs post-dosing. Blood samples (1 mL) were collected in tubes without anticoagulant for serum separation. The tubes were kept at room temperature for approximately 60 min and then centrifuged at 3,000 rpm for 10 min to obtain serum. Levels of various liver function markers were measured using a Toshiba 200FR NEO chemistry analyzer (Toshiba Co., Japan). Plasma levels of ALT and AST were measured and the results are presented in Table 48, expressed in IU/L. Male and female monkey data is presented separately. The results indicate that treatment with ISIS 481464 had no effect on liver function outside the expected range for antisense oligonucleotides.

TABLE 48

Effect of antisense oligonucleotide treatment on liver function markers in cynomolgus monkey plasma

| | Male ALT (IU/L) | Female ALT (IU/L) | Male AST (IU/L) | Female AST (IU/L) |
| --- | --- | --- | --- | --- |
| PBS | 59 | 69 | 83 | 69 |
| 3 mg/kg i.v. | 47 | 56 | 50 | 47 |
| 10 mg/kg i.v. | 56 | 89 | 70 | 60 |
| 30 mg/kg i.v. | 74 | 75 | 60 | 73 |
| 30 mg/kg s.c. | 62 | 78 | 61 | 92 |

Kidney Function

To evaluate the effect of ISIS oligonucleotides on kidney function, blood samples were collected from all the study groups. The blood samples were collected via femoral venipuncture on day 44, 48 hrs post-dosing. Blood samples (1 mL) were collected in tubes without anticoagulant for serum separation. The tubes were kept at room temperature for approximately 60 min and then centrifuged at 3,000 rpm for 10 min to obtain serum. Levels of various kidney function markers were measured using a Toshiba 200FR NEO chemistry analyzer (Toshiba Co., Japan). Results are presented in Table 49, expressed in mg/dL. The plasma chemistry data indicate that treatment with ISIS 481464 did not have any effect on the kidney function outside the expected range for antisense oligonucleotides.

TABLE 49

Effect of antisense oligonucleotide treatment on plasma BUN and creatinine levels (mg/dL) in cynomolgus monkeys

|  | Male BUN | Female BUN | Male Creatinine | Female Creatinine |
| --- | --- | --- | --- | --- |
| PBS | 19 | 30 | 0.68 | 0.88 |
| 3 mg/kg i.v. | 23 | 28 | 0.85 | 0.86 |
| 10 mg/kg i.v. | 26 | 27 | 0.89 | 0.94 |
| 30 mg/kg i.v. | 25 | 26 | 0.91 | 0.86 |
| 30 mg/kg s.c. | 27 | 28 | 0.97 | 0.85 |

Body Weight Measurements

To evaluate the effect of ISIS oligonucleotides on the overall health of the animals, body weights were measured and are presented in Tables 50 and 51. The results indicate that effect of treatment with ISIS 481464 on body weights was within the expected range for antisense oligonucleotides.

TABLE 50

Effect of antisense oligonucleotide treatment on body weights (g) in male cynomolgus monkeys

|  | Day 1 | Day 7 | Day 14 | Day 21 | Day 28 | Day 35 | Day 42 |
| --- | --- | --- | --- | --- | --- | --- | --- |
| PBS | 2523 | 2463 | 2484 | 2471 | 2509 | 2523 | 2551 |
| 3 mg/kg i.v. | 2604 | 2564 | 2594 | 2572 | 2589 | 2654 | 2687 |
| 10 mg/kg i.v. | 2603 | 2453 | 2581 | 2561 | 2591 | 2633 | 2655 |
| 30 mg/kg i.v. | 2608 | 2583 | 2613 | 2644 | 2668 | 2713 | 2776 |
| 30 mg/kg s.c. | 2533 | 2441 | 2470 | 2521 | 2554 | 2609 | 2619 |

TABLE 51

Effect of antisense oligonucleotide treatment on body weights (g) in female cynomolgus monkeys

|  | Day 1 | Day 7 | Day 14 | Day 21 | Day 28 | Day 35 | Day 42 |
| --- | --- | --- | --- | --- | --- | --- | --- |
| PBS | 2266 | 2252 | 2276 | 2237 | 2362 | 2365 | 2373 |
| 3 mg/kg i.v. | 2253 | 2242 | 2283 | 2250 | 2346 | 2350 | 2377 |
| 10 mg/kg i.v. | 2293 | 2277 | 2318 | 2254 | 2358 | 2387 | 2361 |
| 30 mg/kg i.v. | 2259 | 2261 | 2289 | 2268 | 2368 | 2412 | 2406 |
| 30 mg/kg s.c. | 2293 | 2275 | 2322 | 2281 | 2385 | 2389 | 2394 |

Example 32

Antisense Inhibition of Human STAT3 in HuVEC Cells

Antisense oligonucleotides were designed targeting a STAT3 nucleic acid and were tested for their effects on STAT3 mRNA in vitro. Cultured HuVEC cells at a density of 5,000 cells per well were transfected using LipofectAMINE 2000® reagent with 30 nM antisense oligonucleotide. After a treatment period of approximately 24 hours, RNA was isolated from the cells and STAT3 mRNA levels were measured by quantitative real-time PCR. Human primer probe set RTS2033 (forward sequence GAGGCCCGCCCAACA, designated herein as SEQ ID NO: 5; reverse sequence TTCTGCTAATGACGTTATCCAGTTTT, designated herein as SEQ ID NO: 6; probe sequence CTGCCTAGATCGGC, designated herein as SEQ ID NO: 7) was used to measure mRNA levels. STAT3 mRNA levels were adjusted according to total RNA content, as measured by RIBOGREEN®. Results are presented as percent inhibition of STAT3, relative to untreated control cells.

The chimeric antisense oligonucleotides in Tables 52 and 53 were designed as 5-10-5 MOE gapmers. The gapmers are 20 nucleosides in length, wherein the central gap segment comprises of ten 2'-deoxynucleosides and is flanked on both sides (in the 5' and 3' directions) by wings comprising five nucleosides each. Each nucleoside in the 5' wing segment and each nucleotide in the 3' wing segment has a 2'-MOE modification. The internucleoside linkages throughout each gapmer are phosphorothioate (P=S) linkages. All cytosine residues throughout each gapmer are 5'-methylcytosines. "Human Target start site" indicates the 5'-most nucleoside to which the gapmer is targeted in the human gene sequence. "Human Target stop site" indicates the 3'-most nucleoside to which the gapmer is targeted human gene sequence. Each gapmer listed in Table 52 is targeted to human STAT3 mRNA, designated herein as SEQ ID NO: 1 (GENBANK Accession No. NM_139276.2). Each gapmer listed in Table 53 is targeted to human STAT3 genomic sequence, designated herein as SEQ ID NO: 2 (the complement of GENBANK Accession No. NT_010755.14 truncated from nucleotides 4185000 to 4264000).

The potency of the gapmers was compared to ISIS 337332, ISIS 337333, and ISIS 345785, which are also 5-10-5 MOE gapmers targeting human STAT3, and which are further described in U.S. Pat. No. 7,307,069, incorporated herein by reference.

TABLE 52

Inhibition of human STAT3 mRNA levels by chimeric antisense oligonucleotides having 5-10-5 MOE wings and deoxy gap targeted to SEQ ID NO: 1

| ISIS NO | Human Start Site | Human Stop Site | Sequence | % inhibition | SEQ ID NO |
| --- | --- | --- | --- | --- | --- |
| 337332 | 1898 | 1917 | GAAGCCCTTGCCAGCCATGT | 91 | 1541 |
| 337333 | 1903 | 1922 | AAGGAGAAGCCCTTGCCAGC | 87 | 1542 |
| 345785 | 2267 | 2286 | TGCCTCCTCCTTGGGAATGT | 82 | 1543 |
| 455860 | 2831 | 2850 | ACACAAGACATTTCCTTTTT | 64 | 1544 |
| 455246 | 3452 | 3471 | CAAGGAGGCTGTTAACTGAA | 84 | 1545 |
| 455247 | 3454 | 3473 | ACCAAGGAGGCTGTTAACTG | 78 | 1546 |
| 455248 | 3456 | 3475 | GCACCAAGGAGGCTGTTAAC | 69 | 1547 |
| 455249 | 3458 | 3477 | AAGCACCAAGGAGGCTGTTA | 83 | 1548 |
| 455250 | 3460 | 3479 | TAAAGCACCAAGGAGGCTGT | 77 | 1549 |
| 455251 | 3462 | 3481 | CTTAAAGCACCAAGGAGGCT | 78 | 1550 |
| 455252 | 3464 | 3483 | TGCTTAAAGCACCAAGGAGG | 80 | 1551 |
| 455253 | 3466 | 3485 | AATGCTTAAAGCACCAAGGA | 75 | 1552 |

TABLE 52-continued

Inhibition of human STAT3 mRNA levels by chimeric antisense oligonucleotides having 5-10-5 MOE wings and deoxy gap targeted to SEQ ID NO: 1

| ISIS NO | Human Start Site | Human Stop Site | Sequence | % inhibition | SEQ ID NO |
|---|---|---|---|---|---|
| 455254 | 3468 | 3487 | TGAATGCTTAAAGCACCAAG | 80 | 1553 |
| 455255 | 3470 | 3489 | GCTGAATGCTTAAAGCACCA | 82 | 1554 |
| 455256 | 3472 | 3491 | AAGCTGAATGCTTAAAGCAC | 67 | 1555 |
| 455257 | 3474 | 3493 | GGAAGCTGAATGCTTAAAGC | 79 | 1556 |
| 455258 | 3476 | 3495 | AAGGAAGCTGAATGCTTAAA | 79 | 1557 |
| 455259 | 3478 | 3497 | TGAAGGAAGCTGAATGCTTA | 72 | 1558 |
| 455260 | 3480 | 3499 | CCTGAAGGAAGCTGAATGCT | 75 | 1559 |
| 455261 | 3527 | 3546 | TAAGGGTTTGACCTGAAGCC | 72 | 1560 |
| 455262 | 3577 | 3596 | TAAACCTTCCTATTTCAACA | 77 | 1561 |
| 455263 | 3579 | 3598 | CTTAAACCTTCCTATTTCAA | 64 | 1562 |
| 455264 | 3581 | 3600 | TCCTTAAACCTTCCTATTTC | 73 | 1563 |
| 455265 | 3583 | 3602 | TCTCCTTAAACCTTCCTATT | 87 | 1564 |
| 455266 | 3585 | 3604 | ATTCTCCTTAAACCTTCCTA | 80 | 1565 |
| 455267 | 3587 | 3606 | AGATTCTCCTTAAACCTTCC | 87 | 1566 |
| 455268 | 3589 | 3608 | TTAGATTCTCCTTAAACCTT | 84 | 1567 |
| 455269 | 3591 | 3610 | GCTTAGATTCTCCTTAAACC | 87 | 1568 |
| 455270 | 3593 | 3612 | ATGCTTAGATTCTCCTTAAA | 87 | 1569 |
| 455271 | 3595 | 3614 | AAATGCTTAGATTCTCCTTA | 89 | 1570 |
| 455272 | 3597 | 3616 | TAAAATGCTTAGATTCTCCT | 88 | 1571 |
| 455273 | 3639 | 3658 | ATACATTACAAAGGAAAATA | 12 | 1572 |
| 455274 | 3641 | 3660 | CAATACATTACAAAGGAAAA | 28 | 1573 |
| 455275 | 3673 | 3692 | CACCCTCTGCCCAGCCTTAC | 63 | 1574 |
| 455276 | 3675 | 3694 | AGCACCCTCTGCCCAGCCTT | 79 | 1575 |
| 455277 | 3677 | 3696 | TAAGCACCCTCTGCCCAGCC | 65 | 1576 |
| 455278 | 3679 | 3698 | TGTAAGCACCCTCTGCCCAG | 62 | 1577 |
| 455279 | 3681 | 3700 | GTTGTAAGCACCCTCTGCCC | 62 | 1578 |
| 455280 | 3683 | 3702 | AGGTTGTAAGCACCCTCTGC | 75 | 1579 |
| 455281 | 3685 | 3704 | CAAGGTTGTAAGCACCCTCT | 83 | 1580 |
| 455282 | 3687 | 3706 | GTCAAGGTTGTAAGCACCCT | 86 | 1581 |
| 455283 | 3689 | 3708 | GAGTCAAGGTTGTAAGCACC | 69 | 1582 |
| 455284 | 3691 | 3710 | GGGAGTCAAGGTTGTAAGCA | 37 | 1583 |
| 455285 | 3693 | 3712 | AAGGGAGTCAAGGTTGTAAG | 56 | 1584 |
| 455286 | 3695 | 3714 | GAAAGGGAGTCAAGGTTGTA | 61 | 1585 |
| 455287 | 3697 | 3716 | GAGAAAGGGAGTCAAGGTTG | 56 | 1586 |
| 455288 | 3709 | 3728 | ATCAAGTCCAGGGAGAAAGG | 55 | 1587 |
| 455289 | 3711 | 3730 | AGATCAAGTCCAGGGAGAAA | 69 | 1588 |
| 455290 | 3713 | 3732 | GCAGATCAAGTCCAGGGAGA | 80 | 1589 |
| 455291 | 3715 | 3734 | CAGCAGATCAAGTCCAGGGA | 90 | 1590 |
| 455292 | 3717 | 3736 | AACAGCAGATCAAGTCCAGG | 77 | 1591 |
| 455293 | 3719 | 3738 | GAAACAGCAGATCAAGTCCA | 81 | 1592 |
| 455294 | 3721 | 3740 | CTGAAACAGCAGATCAAGTC | 75 | 1593 |
| 455295 | 3723 | 3742 | CTCTGAAACAGCAGATCAAG | 76 | 1594 |
| 455296 | 3725 | 3744 | GCCTCTGAAACAGCAGATCA | 74 | 1595 |
| 455297 | 3727 | 3746 | TAGCCTCTGAAACAGCAGAT | 75 | 1596 |
| 455298 | 3729 | 3748 | CCTAGCCTCTGAAACAGCAG | 76 | 1597 |
| 455299 | 3731 | 3750 | AACCTAGCCTCTGAAACAGC | 83 | 1598 |
| 455300 | 3733 | 3752 | ACAACCTAGCCTCTGAAACA | 57 | 1599 |
| 455301 | 3735 | 3754 | AAACAACCTAGCCTCTGAAA | 72 | 1600 |
| 455302 | 3737 | 3756 | AGAAACAACCTAGCCTCTGA | 78 | 1601 |
| 455303 | 3739 | 3758 | ACAGAAACAACCTAGCCTCT | 69 | 1602 |
| 455304 | 3741 | 3760 | CCACAGAAACAACCTAGCCT | 70 | 1603 |
| 455305 | 3743 | 3762 | ACCCACAGAAACAACCTAGC | 80 | 1604 |
| 455306 | 3745 | 3764 | GCACCCACAGAAACAACCTA | 70 | 1605 |
| 455307 | 3747 | 3766 | AGGCACCCACAGAAACAACC | 75 | 1606 |
| 455308 | 3749 | 3768 | TAAGGCACCCACAGAAACAA | 70 | 1607 |
| 455309 | 3751 | 3770 | GATAAGGCACCCACAGAAAC | 65 | 1608 |
| 455310 | 3753 | 3772 | CTGATAAGGCACCCACAGAA | 66 | 1609 |
| 455311 | 3755 | 3774 | CCCTGATAAGGCACCCACAG | 81 | 1610 |
| 455312 | 3757 | 3776 | AGCCCTGATAAGGCACCCAC | 79 | 1611 |
| 455313 | 3759 | 3778 | CCAGCCCTGATAAGGCACCC | 74 | 1612 |
| 455314 | 3761 | 3780 | TCCCAGCCCTGATAAGGCAC | 74 | 1613 |
| 455315 | 3763 | 3782 | TATCCCAGCCCTGATAAGGC | 66 | 1614 |
| 455316 | 3765 | 3784 | AGTATCCCAGCCCTGATAAG | 48 | 1615 |
| 455317 | 3767 | 3786 | GAAGTATCCCAGCCCTGATA | 63 | 1616 |
| 455318 | 3769 | 3788 | CAGAAGTATCCCAGCCCTGA | 82 | 1617 |
| 455319 | 3771 | 3790 | ATCAGAAGTATCCCAGCCCT | 80 | 1618 |
| 455320 | 3879 | 3898 | GATTCCTAAAACAAACAGGA | 37 | 1619 |
| 455321 | 3881 | 3900 | AGGATTCCTAAAACAAACAG | 42 | 1620 |
| 455322 | 3883 | 3902 | CCAGGATTCCTAAAACAAAC | 72 | 1621 |
| 455323 | 3885 | 3904 | GACCAGGATTCCTAAAACAA | 71 | 1622 |
| 455324 | 3887 | 3906 | GAGACCAGGATTCCTAAAAC | 43 | 1623 |

TABLE 52-continued

Inhibition of human STAT3 mRNA levels by chimeric antisense oligonucleotides having 5-10-5 MOE wings and deoxy gap targeted to SEQ ID NO: 1

| ISIS NO | Human Start Site | Human Stop Site | Sequence | % inhibition | SEQ ID NO |
|---|---|---|---|---|---|
| 455325 | 3889 | 3908 | CTGAGACCAGGATTCCTAAA | 77 | 1624 |
| 455326 | 3891 | 3910 | TCCTGAGACCAGGATTCCTA | 76 | 1625 |
| 455327 | 3893 | 3912 | GGTCCTGAGACCAGGATTCC | 69 | 1626 |
| 455328 | 3895 | 3914 | GAGGTCCTGAGACCAGGATT | 76 | 1627 |
| 455329 | 3897 | 3916 | ATGAGGTCCTGAGACCAGGA | 81 | 1628 |
| 455330 | 3899 | 3918 | CCATGAGGTCCTGAGACCAG | 84 | 1629 |
| 455331 | 3901 | 3920 | TTCCATGAGGTCCTGAGACC | 75 | 1630 |
| 455332 | 3903 | 3922 | TCTTCCATGAGGTCCTGAGA | 75 | 1631 |
| 455333 | 3905 | 3924 | CTTCTTCCATGAGGTCCTGA | 79 | 1632 |
| 455334 | 3907 | 3926 | CTCTTCTTCCATGAGGTCCT | 83 | 1633 |
| 455335 | 3909 | 3928 | CCCTCTTCTTCCATGAGGTC | 74 | 1634 |
| 455336 | 3911 | 3930 | CCCCCTCTTCYFCCATGAGG | 72 | 1635 |
| 455337 | 3913 | 3932 | CTCCCCCTCTTCTTCCATGA | 72 | 1636 |
| 455338 | 3977 | 3996 | CCTGAGCTCAACCAGACACG | 79 | 1637 |
| 455339 | 3979 | 3998 | TCCCTGAGCTCAACCAGACA | 73 | 1638 |
| 455340 | 3981 | 4000 | ATTCCCTGAGCTCAACCAGA | 75 | 1639 |
| 455341 | 3983 | 4002 | ATATTCCCTGAGCTCAACCA | 65 | 1640 |
| 455342 | 3985 | 4004 | CCATATTCCCTGAGCTCAAC | 78 | 1641 |
| 455343 | 3987 | 4006 | AACCATATTCCCTGAGCTCA | 81 | 1642 |
| 455344 | 3989 | 4008 | AGAACCATATTCCCTGAGCT | 77 | 1643 |
| 455345 | 3991 | 4010 | TAAGAACCATATTCCCTGAG | 73 | 1644 |
| 455346 | 3993 | 4012 | GCTAAGAACCATATTCCCTG | 81 | 1645 |
| 455347 | 4067 | 4086 | TCAGTAAGCCTTTGCCCTGC | 79 | 1646 |
| 455348 | 4069 | 4088 | TATCAGTAAGCCTTTGCCCT | 72 | 1647 |
| 455349 | 4071 | 4090 | TTTATCAGTAAGCCTTTGCC | 76 | 1648 |
| 455350 | 4073 | 4092 | AGTTTATCAGTAAGCCTTTG | 84 | 1649 |
| 455351 | 4075 | 4094 | CAAGTTTATCAGTAAGCCTT | 82 | 1650 |
| 455352 | 4077 | 4096 | CTCAAGTTTATCAGTAAGCC | 82 | 1651 |
| 455353 | 4079 | 4098 | GACTCAAGTTTATCAGTAAG | 70 | 1652 |
| 455354 | 4081 | 4100 | CAGACTCAAGTTTATCAGTA | 78 | 1653 |
| 455355 | 4083 | 4102 | GGCAGACTCAAGTTTATCAG | 67 | 1654 |
| 455356 | 4085 | 4104 | AGGGCAGACTCAAGTTTATC | 51 | 1655 |
| 455357 | 4087 | 4106 | CGAGGGCAGACTCAAGTTTA | 54 | 1656 |
| 455358 | 4089 | 4108 | TACGAGGGCAGACTCAAGTT | 56 | 1657 |
| 455359 | 4091 | 4110 | CATACGAGGGCAGACTCAAG | 59 | 1658 |
| 455360 | 4093 | 4112 | CTCATACGAGGGCAGACTCA | 74 | 1659 |
| 455361 | 4095 | 4114 | CCCTCATACGAGGGCAGACT | 67 | 1660 |
| 455362 | 4122 | 4141 | CAGCCTCAGAGGGAGGCCAG | 40 | 1661 |
| 455363 | 4124 | 4143 | ACCAGCCTCAGAGGGAGGCC | 34 | 1662 |
| 455364 | 4126 | 4145 | TCACCAGCCTCAGAGGGAGG | 49 | 1663 |
| 455365 | 4128 | 4147 | AGTCACCAGCCTCAGAGGGA | 50 | 1664 |
| 455366 | 4225 | 4244 | CCCATACGCACAGGAGAGGC | 81 | 1665 |
| 455367 | 4227 | 4246 | TTCCCATACGCACAGGAGAG | 72 | 1666 |
| 455368 | 4229 | 4248 | TGTTCCCATACGCACAGGAG | 80 | 1667 |
| 455369 | 4231 | 4250 | GGTGTTCCCATACGCACAGG | 76 | 1668 |
| 455370 | 4233 | 4252 | TAGGTGTTCCCATACGCACA | 87 | 1669 |
| 455371 | 4235 | 4254 | GCTAGGTGTTCCCATACGCA | 92 | 1670 |
| 455372 | 4237 | 4256 | GTGCTAGGTGTTCCCATACG | 81 | 1671 |
| 455373 | 4304 | 4323 | GAGGCAAGGTGGTTTTGAGT | 55 | 1672 |
| 455374 | 4306 | 4325 | CTGAGGCAAGGTGGTTTTGA | 74 | 1673 |
| 455375 | 4308 | 4327 | AGCTGAGGCAAGGTGGTTTT | 79 | 1674 |
| 455376 | 4310 | 4329 | TCAGCTGAGGCAAGGTGGTT | 80 | 1675 |
| 455377 | 4312 | 4331 | GATCAGCTGAGGCAAGGTGG | 77 | 1676 |
| 455378 | 4314 | 4333 | CTGATCAGCTGAGGCAAGGT | 60 | 1677 |
| 455379 | 4316 | 4335 | CTCTGATCAGCTGAGGCAAG | 74 | 1678 |
| 455380 | 4318 | 4337 | AACTCTGATCAGCTGAGGCA | 77 | 1679 |
| 455381 | 4320 | 4339 | GAAACTCTGATCAGCTGAGG | 78 | 1680 |
| 455382 | 4322 | 4341 | CAGAAACTCTGATCAGCTGA | 78 | 1681 |
| 455383 | 4360 | 4379 | CAGAGACCAGCTAATTTGAT | 69 | 1682 |
| 455384 | 4362 | 4381 | TTCAGAGACCAGCTAATTTG | 78 | 1683 |
| 455385 | 4364 | 4383 | AATTCAGAGACCAGCTAATT | 77 | 1684 |
| 455386 | 4366 | 4385 | TTAATTCAGAGACCAGCTAA | 83 | 1685 |
| 455387 | 4423 | 4442 | CTCCAGGCAGGAGGACTGGG | 79 | 1686 |
| 455388 | 4425 | 4444 | GTCTCCAGGCAGGAGGACTG | 65 | 1687 |
| 455389 | 4427 | 4446 | CTGTCTCCAGGCAGGAGGAC | 57 | 1688 |
| 455390 | 4429 | 4448 | AACTGTCTCCAGGCAGGAGG | 75 | 1689 |
| 455391 | 4431 | 4450 | TCAACTGTCTCCAGGCAGGA | 86 | 1690 |
| 455392 | 4433 | 4452 | CATCAACTGTCTCCAGGCAG | 80 | 1691 |
| 455393 | 4435 | 4454 | CACATCAACTGTCTCCAGGC | 86 | 1692 |
| 455394 | 4437 | 4456 | GACACATCAACTGTCTCCAG | 85 | 1693 |
| 455395 | 4471 | 4490 | GAAGAGTGTTGCTGGAGAAG | 73 | 1694 |

TABLE 52-continued

Inhibition of human STAT3 mRNA levels by chimeric antisense oligonucleotides having 5-10-5 MOE wings and deoxy gap targeted to SEQ ID NO: 1

| ISIS NO | Human Start Site | Human Stop Site | Sequence | % inhibition | SEQ ID NO |
|---|---|---|---|---|---|
| 455396 | 4473 | 4492 | CTGAAGAGTGTTGCTGGAGA | 78 | 1695 |
| 455397 | 4475 | 4494 | TACTGAAGAGTGTTGCTGGA | 83 | 1696 |
| 455398 | 4477 | 4496 | TGTACTGAAGAGTGTTGCTG | 86 | 1697 |
| 455399 | 4479 | 4498 | TATGTACTGAAGAGTGTTGC | 74 | 1698 |
| 455400 | 4481 | 4500 | ATTATGTACTGAAGAGTGTT | 74 | 1699 |
| 455401 | 4483 | 4502 | TTATTATGTACTGAAGAGTG | 84 | 1700 |
| 455402 | 4485 | 4504 | GCTTATTATGTACTGAAGAG | 84 | 1701 |
| 455403 | 4487 | 4506 | AAGCTTATTATGTACTGAAG | 77 | 1702 |
| 455404 | 4489 | 4508 | TTAAGCTTATTATGTACTGA | 75 | 1703 |
| 455405 | 4491 | 4510 | AGTTAAGCTTATTATGTACT | 81 | 1704 |
| 455406 | 4493 | 4512 | TCAGTTAAGCTTATTATGTA | 58 | 1705 |
| 455407 | 4495 | 4514 | TATCAGTTAAGCTTATTATG | 65 | 1706 |
| 455408 | 4497 | 4516 | TTTATCAGTTAAGCTTATTA | 46 | 1707 |
| 455409 | 4499 | 4518 | TGTTTATCAGTTAAGCTTAT | 68 | 1708 |
| 455410 | 4501 | 4520 | TCTGTTTATCAGTTAAGCTT | 83 | 1709 |
| 455411 | 4539 | 4558 | AACCCAATGGTAAGCCCAAG | 87 | 1710 |
| 455412 | 4541 | 4560 | TAAACCCAATGGTAAGCCCA | 87 | 1711 |
| 455413 | 4543 | 4562 | TTTAAACCCAATGGTAAGCC | 78 | 1712 |
| 455414 | 4545 | 4564 | GATTTAAACCCAATGGTAAG | 31 | 1713 |
| 455415 | 4547 | 4566 | ATGATTTAAACCCAATGGTA | 71 | 1714 |
| 455416 | 4549 | 4568 | CTATGATTTAAACCCAATGG | 67 | 1715 |
| 455417 | 4551 | 4570 | CCCTATGATTTAAACCCAAT | 70 | 1716 |
| 455418 | 4553 | 4572 | GTCCCTATGATTTAAACCCA | 83 | 1717 |
| 455419 | 4555 | 4574 | AGGTCCCTATGATTTAAACC | 64 | 1718 |
| 455420 | 4589 | 4608 | TATCTGCTCCAGAGAAGCCC | 76 | 1719 |
| 455421 | 4591 | 4610 | AATATCTGCTCCAGAGAAGC | 78 | 1720 |
| 455422 | 4614 | 4633 | CTACCTAAGGCCATGAACTT | 74 | 1721 |
| 455423 | 4616 | 4635 | TGCTACCTAAGGCCATGAAC | 82 | 1722 |
| 455424 | 4618 | 4637 | CATGCTACCTAAGGCCATGA | 84 | 1723 |
| 455425 | 4636 | 4655 | CAGAGTTAAGACCAGATACA | 84 | 1724 |
| 455426 | 4638 | 4657 | ATCAGAGTTAAGACCAGATA | 83 | 1725 |
| 455427 | 4640 | 4659 | CAATCAGAGTTAAGACCAGA | 77 | 1726 |
| 455428 | 4642 | 4661 | TACAATCAGAGTTAAGACCA | 81 | 1727 |
| 455429 | 4644 | 4663 | GCTACAATCAGAGTTAAGAC | 86 | 1728 |
| 455430 | 4646 | 4665 | TTGCTACAATCAGAGTTAAG | 85 | 1729 |
| 455431 | 4648 | 4667 | TTTTGCTACAATCAGAGTTA | 85 | 1730 |
| 455432 | 4650 | 4669 | ACTTTTGCTACAATCAGAGT | 73 | 1731 |
| 455433 | 4652 | 4671 | GAACTTTTGCTACAATCAGA | 80 | 1732 |
| 455434 | 4654 | 4673 | CAGAACTTTTGCTACAATCA | 82 | 1733 |
| 455435 | 4656 | 4675 | CTCAGAACTTTTGCTACAAT | 79 | 1734 |
| 455436 | 4658 | 4677 | CTCTCAGAACTTTTGCTACA | 76 | 1735 |
| 455437 | 4660 | 4679 | TCCTCTCAGAACTTTTGCTA | 75 | 1736 |
| 455438 | 4662 | 4681 | GCTCCTCTCAGAACTTTTGC | 85 | 1737 |
| 455439 | 4664 | 4683 | CAGCTCCTCTCAGAACTTTT | 85 | 1738 |
| 455440 | 4666 | 4685 | CTCAGCTCCTCTCAGAACTT | 80 | 1739 |
| 455441 | 4668 | 4687 | GGCTCAGCTCCTCTCAGAAC | 75 | 1740 |
| 455442 | 4770 | 4789 | GCAACCCACGGGATTCCCTC | 82 | 1741 |
| 455443 | 4772 | 4791 | AAGCAACCCACGGGATTCCC | 77 | 1742 |
| 455444 | 4774 | 4793 | GTAAGCAACCCACGGGATTC | 74 | 1743 |
| 455445 | 4776 | 4795 | AGGTAAGCAACCCACGGGAT | 76 | 1744 |
| 455446 | 4778 | 4797 | GTAGGTAAGCAACCCACGGG | 82 | 1745 |
| 455447 | 4780 | 4799 | AGGTAGGTAAGCAACCCACG | 88 | 1746 |
| 455448 | 4782 | 4801 | ATAGGTAGGTAAGCAACCCA | 83 | 1747 |
| 455449 | 4784 | 4803 | TTATAGGTAGGTAAGCAACC | 59 | 1748 |
| 455450 | 4786 | 4805 | CCTTATAGGTAGGTAAGCAA | 65 | 1749 |
| 455451 | 4788 | 4807 | CACCTTATAGGTAGGTAAGC | 62 | 1750 |
| 455452 | 4790 | 4809 | ACCACCTTATAGGTAGGTAA | 57 | 1751 |
| 455453 | 4792 | 4811 | AAACCACCTTATAGGTAGGT | 75 | 1752 |
| 455454 | 4794 | 4813 | ATAAACCACCTTATAGGTAG | 35 | 1753 |
| 455455 | 4796 | 4815 | TTATAAACCACCTTATAGGT | 39 | 1754 |
| 455456 | 4798 | 4817 | GCTTATAAACCACCTTATAG | 58 | 1755 |
| 455457 | 4800 | 4819 | CAGCTTATAAACCACCTTAT | 86 | 1756 |
| 455458 | 4802 | 4821 | AGCAGCTTATAAACCACCTT | 86 | 1757 |
| 455459 | 4804 | 4823 | ACAGCAGCTTATAAACCACC | 80 | 1758 |
| 455460 | 4806 | 4825 | GGACAGCAGCTTATAAACCA | 69 | 1759 |
| 455461 | 4808 | 4827 | CAGGACAGCAGCTTATAAAC | 72 | 1760 |
| 455462 | 4810 | 4829 | GCCAGGACAGCAGCTTATAA | 76 | 1761 |
| 455463 | 4812 | 4831 | TGGCCAGGACAGCAGCTTAT | 89 | 1762 |
| 455464 | 4814 | 4833 | AGTGGCCAGGACAGCAGCTT | 80 | 1763 |
| 455465 | 4816 | 4835 | GCAGTGGCCAGGACAGCAGC | 78 | 1764 |
| 455466 | 4818 | 4837 | ATGCAGTGGCCAGGACAGCA | 85 | 1765 |

TABLE 52-continued

Inhibition of human STAT3 mRNA levels by chimeric antisense oligonucleotides having 5-10-5 MOE wings and deoxy gap targeted to SEQ ID NO: 1

| ISIS NO | Human Start Site | Human Stop Site | Sequence | % inhibition | SEQ ID NO |
|---|---|---|---|---|---|
| 455467 | 4820 | 4839 | GAATGCAGTGGCCAGGACAG | 80 | 1766 |
| 455468 | 4822 | 4841 | TTGAATGCAGTGGCCAGGAC | 83 | 1767 |
| 455469 | 4824 | 4843 | ATTTGAATGCAGTGGCCAGG | 84 | 1768 |
| 455470 | 4826 | 4845 | GAATTTGAATGCAGTGGCCA | 81 | 1769 |
| 455471 | 4828 | 4847 | TGGAATTTGAATGCAGTGGC | 85 | 1770 |
| 455472 | 4830 | 4849 | ATTGGAATTTGAATGCAGTG | 64 | 1771 |
| 455473 | 4832 | 4851 | ACATTGGAATTTGAATGCAG | 80 | 1772 |
| 455474 | 4834 | 4853 | ACACATTGGAATTTGAATGC | 73 | 1773 |
| 455475 | 4836 | 4855 | GTACACATTGGAATTTGAAT | 80 | 1774 |
| 455476 | 4838 | 4857 | AAGTACACATTGGAATTTGA | 77 | 1775 |
| 455477 | 4840 | 4859 | TGAAGTACACATTGGAATTT | 68 | 1776 |
| 455478 | 4842 | 4861 | TATGAAGTACACATTGGAAT | 66 | 1777 |
| 455479 | 4844 | 4863 | ACTATGAAGTACACATTGGA | 83 | 1778 |
| 455480 | 4846 | 4865 | ACACTATGAAGTACACATTG | 76 | 1779 |
| 455481 | 4848 | 4867 | TTACACTATGAAGTACACAT | 78 | 1780 |
| 455482 | 4850 | 4869 | TTTTACACTATGAAGTACAC | 76 | 1781 |
| 455483 | 4852 | 4871 | ATTTTTACACTATGAAGTAC | 60 | 1782 |
| 455484 | 4854 | 4873 | AAATTTTTACACTATGAAGT | 35 | 1783 |
| 455485 | 4856 | 4875 | ATAAATTTTTACACTATGAA | 9 | 1784 |
| 455486 | 4858 | 4877 | ATATAAATTTTTACACTATG | 0 | 1785 |
| 455487 | 4860 | 4879 | TAATATAAATTTTTACACTA | 21 | 1786 |
| 455488 | 4862 | 4881 | AATAATATAAATTTTTACAC | 10 | 1787 |
| 455489 | 4864 | 4883 | ACAATAATATAAATTTTTAC | 7 | 1788 |
| 455490 | 4925 | 4944 | AGTTAAAGTAGATACAGCAA | 71 | 1789 |
| 455491 | 4927 | 4946 | GAAGTTAAAGTAGATACAGC | 63 | 1790 |
| 455492 | 4929 | 4948 | TGGAAGTTAAAGTAGATACA | 69 | 1791 |
| 455493 | 4931 | 4950 | TCTGGAAGTTAAAGTAGATA | 65 | 1792 |
| 455494 | 4933 | 4952 | TTTCTGGAAGTTAAAGTAGA | 55 | 1793 |
| 455495 | 4935 | 4954 | TATTTCTGGAAGTTAAAGTA | 57 | 1794 |
| 455496 | 4937 | 4956 | TTTATTTCTGGAAGTTAAAG | 36 | 1795 |
| 455497 | 4939 | 4958 | CGTTTATTTCTGGAAGTTAA | 77 | 1796 |

TABLE 53

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455498 | 917 | 936 | CACGCCGTCATGCATAATTC | 0 | 1797 |
| 455499 | 919 | 938 | GGCACGCCGTCATGCATAAT | 0 | 1798 |
| 455500 | 940 | 959 | GCCCAGCCCCAGCCTGGCCG | 35 | 1799 |
| 455501 | 962 | 981 | ACAGCCCCTTCAGCCAATCC | 15 | 1800 |
| 455502 | 964 | 983 | TTACAGCCCCTTCAGCCAAT | 14 | 1801 |
| 455503 | 966 | 985 | AATTACAGCCCCTTCAGCCA | 28 | 1802 |
| 455504 | 968 | 987 | TGAATTACAGCCCCTTCAGC | 6 | 1803 |
| 455505 | 970 | 989 | GCTGAATTACAGCCCCTTCA | 15 | 1804 |
| 455506 | 972 | 991 | CCGCTGAATTACAGCCCCTT | 4 | 1805 |
| 455507 | 974 | 993 | AACCGCTGAATTACAGCCCC | 8 | 1806 |
| 455508 | 976 | 995 | GAAACCGCTGAATTACAGCC | 16 | 1807 |
| 455509 | 978 | 997 | CGGAAACCGCTGAATTACAG | 24 | 1808 |
| 455510 | 980 | 999 | TCCGGAAACCGCTGAATTAC | 12 | 1809 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455511 | 982 | 1001 | GCTCCGGAAACCGCTGAATT | 15 | 1810 |
| 455512 | 984 | 1003 | CAGCTCCGGAAACCGCTGAA | 23 | 1811 |
| 455513 | 986 | 1005 | CGCAGCTCCGGAAACCGCTG | 4 | 1812 |
| 455514 | 988 | 1007 | GCCGCAGCTCCGGAAACCGC | 13 | 1813 |
| 455515 | 1378 | 1397 | AGTCCCTTCCGAGGCCCGCT | 81 | 1814 |
| 455516 | 1408 | 1427 | CGAAGAACGAAACTTCCCTC | 68 | 1815 |
| 455517 | 1697 | 1716 | CAGACACACCTATTCCTGCC | 82 | 1816 |
| 455518 | 1748 | 1767 | TTATGCAATAAAGCCTACCC | 70 | 1817 |
| 455519 | 1795 | 1814 | TTAGAAAGAGTACCGGTCTG | 75 | 1818 |
| 455520 | 1987 | 2006 | AATGGCTCAATTATTTATCT | 59 | 1819 |
| 455521 | 2083 | 2102 | TTTACCCAAGATCTTGGCTC | 76 | 1820 |
| 455522 | 2175 | 2194 | ACTTCAGTGCAACCACACCC | 70 | 1821 |
| 455523 | 2205 | 2224 | CCAACTTGGGCGACGGTTTG | 67 | 1822 |
| 455524 | 2281 | 2300 | CTAACCACTGATTTTGTCAC | 56 | 1823 |
| 455525 | 2316 | 2335 | GTACACACTATACACATTTT | 85 | 1824 |
| 455526 | 2346 | 2365 | CTTTAGTTGCACATACAGTA | 80 | 1825 |
| 455527 | 2383 | 2402 | GCCAAAAATTTACAACCCAT | 86 | 1826 |
| 455528 | 2413 | 2432 | TTCAAGCCCAATGCTTTATC | 76 | 1827 |
| 455529 | 2561 | 2580 | CTGGAACATGTAATAAGGAA | 71 | 1828 |
| 455530 | 2669 | 2688 | AGAGACTAAAATCAAGGCTC | 87 | 1829 |
| 455531 | 2900 | 2919 | TAGACTCTAGACCCAATTCC | 77 | 1830 |
| 455532 | 3780 | 3799 | GAAATGACCACTGATCAAGC | 74 | 1831 |
| 455533 | 3867 | 3886 | AAGTTGGTCACCACCTCTAC | 81 | 1832 |
| 455534 | 4291 | 4310 | AACTTATTCTTCATAGCAAC | 58 | 1833 |
| 455535 | 4587 | 4606 | TATTTGGGACCCAGTTGAAA | 60 | 1834 |
| 455536 | 5000 | 5019 | AGAACTGAAATTCCTTGGTC | 88 | 1835 |
| 455537 | 5030 | 5049 | AAGTTTTAAAAGCTTCCCCT | 76 | 1836 |
| 455538 | 5554 | 5573 | TCACCCAAAGTACCAAATCA | 71 | 1837 |
| 455539 | 5667 | 5686 | CAAAAGTTATGGTGAAATTT | 44 | 1838 |
| 455540 | 5699 | 5718 | AAGTACTCTTTCAGTGGTTT | 88 | 1839 |
| 455541 | 6844 | 6863 | AATTAAAGAGTTGCGGTAAT | 68 | 1840 |
| 455542 | 6926 | 6945 | GTTTCATGAAAACGGACAAT | 78 | 1841 |
| 455543 | 7050 | 7069 | AGGATTCAGTCCCAGATCTG | 18 | 1842 |
| 455544 | 7282 | 7301 | TCAATAATGATGACTTTCTC | 72 | 1843 |
| 455545 | 7528 | 7547 | TTAAACCCAATTATTAACAG | 45 | 1844 |
| 455546 | 7624 | 7643 | GTAAAACACACATTTTATAT | 62 | 1845 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455547 | 7682 | 7701 | GTAAACAGAAAGGGCTGCAA | 86 | 1846 |
| 455548 | 8078 | 8097 | GGGCAGATTTACCTTCCTTA | 89 | 1847 |
| 455549 | 8126 | 8145 | GGGTAGCAGGAAGGAAAGCC | 80 | 1848 |
| 455550 | 8214 | 8233 | AATATAAGTTCTTTGGCTGA | 60 | 1849 |
| 455551 | 8244 | 8263 | TACAATAGCAATCACCTTAG | 89 | 1850 |
| 455552 | 8284 | 8303 | CCATGAAACCCTCAAACATA | 75 | 1851 |
| 337332 | 66135 | 66154 | GAAGCCCTTGCCAGCCATGT | 91 | 1541 |
| 337333 | 66140 | 66159 | AAGGAGAAGCCCTTGCCAGC | 87 | 1542 |
| 345785 | 67129 | 67148 | TGCCTCCTCCTTGGGAATGT | 82 | 1543 |
| 455246 | 74639 | 74658 | CAAGGAGGCTGTTAACTGAA | 84 | 1545 |
| 455247 | 74641 | 74660 | ACCAAGGAGGCTGTTAACTG | 78 | 1546 |
| 455248 | 74643 | 74662 | GCACCAAGGAGGCTGTTAAC | 69 | 1547 |
| 455249 | 74645 | 74664 | AAGCACCAAGGAGGCTGTTA | 83 | 1548 |
| 455250 | 74647 | 74666 | TAAAGCACCAAGGAGGCTGT | 77 | 1549 |
| 455251 | 74649 | 74668 | CTTAAAGCACCAAGGAGGCT | 78 | 1550 |
| 455252 | 74651 | 74670 | TGCTTAAAGCACCAAGGAGG | 80 | 1551 |
| 455253 | 74653 | 74672 | AATGCTTAAAGCACCAAGGA | 75 | 1552 |
| 455254 | 74655 | 74674 | TGAATGCTTAAAGCACCAAG | 80 | 1553 |
| 455255 | 74657 | 74676 | GCTGAATGCTTAAAGCACCA | 82 | 1554 |
| 455256 | 74659 | 74678 | AAGCTGAATGCTTAAAGCAC | 67 | 1555 |
| 455257 | 74661 | 74680 | GGAAGCTGAATGCTTAAAGC | 79 | 1556 |
| 455258 | 74663 | 74682 | AAGGAAGCTGAATGCTTAAA | 79 | 1557 |
| 455259 | 74665 | 74684 | TGAAGGAAGCTGAATGCTTA | 72 | 1558 |
| 455260 | 74667 | 74686 | CCTGAAGGAAGCTGAATGCT | 75 | 1559 |
| 455261 | 74714 | 74733 | TAAGGGTTTGACCTGAAGCC | 72 | 1560 |
| 455262 | 74764 | 74783 | TAAACCTTCCTATTTCAACA | 77 | 1561 |
| 455263 | 74766 | 74785 | CTTAAACCTTCCTATTTCAA | 64 | 1562 |
| 455264 | 74768 | 74787 | TCCTTAAACCTTCCTATTTC | 73 | 1563 |
| 455265 | 74770 | 74789 | TCTCCTTAAACCTTCCTATT | 87 | 1564 |
| 455266 | 74772 | 74791 | ATTCTCCTTAAACCTTCCTA | 80 | 1565 |
| 455267 | 74774 | 74793 | AGATTCTCCTTAAACCTTCC | 87 | 1566 |
| 455268 | 74776 | 74795 | TTAGATTCTCCTTAAACCTT | 84 | 1567 |
| 455269 | 74778 | 74797 | GCTTAGATTCTCCTTAAACC | 87 | 1568 |
| 455270 | 74780 | 74799 | ATGCTTAGATTCTCCTTAAA | 87 | 1569 |
| 455271 | 74782 | 74801 | AAATGCTTAGATTCTCCTTA | 89 | 1570 |
| 455272 | 74784 | 74803 | TAAAATGCTTAGATTCTCCT | 88 | 1571 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455273 | 74826 | 74845 | ATACATTACAAAGGAAAATA | 12 | 1572 |
| 455274 | 74828 | 74847 | CAATACATTACAAAGGAAAA | 28 | 1573 |
| 455275 | 74860 | 74879 | CACCCTCTGCCCAGCCTTAC | 63 | 1574 |
| 455276 | 74862 | 74881 | AGCACCCTCTGCCCAGCCTT | 79 | 1575 |
| 455277 | 74864 | 74883 | TAAGCACCCTCTGCCCAGCC | 65 | 1576 |
| 455278 | 74866 | 74885 | TGTAAGCACCCTCTGCCCAG | 62 | 1577 |
| 455279 | 74868 | 74887 | GTTGTAAGCACCCTCTGCCC | 62 | 1578 |
| 455280 | 74870 | 74889 | AGGTTGTAAGCACCCTCTGC | 75 | 1579 |
| 455281 | 74872 | 74891 | CAAGGTTGTAAGCACCCTCT | 83 | 1580 |
| 455282 | 74874 | 74893 | GTCAAGGTTGTAAGCACCCT | 86 | 1581 |
| 455283 | 74876 | 74895 | GAGTCAAGGTTGTAAGCACC | 69 | 1582 |
| 455284 | 74878 | 74897 | GGGAGTCAAGGTTGTAAGCA | 37 | 1583 |
| 455285 | 74880 | 74899 | AAGGGAGTCAAGGTTGTAAG | 56 | 1584 |
| 455286 | 74882 | 74901 | GAAAGGGAGTCAAGGTTGTA | 61 | 1585 |
| 455287 | 74884 | 74903 | GAGAAAGGGAGTCAAGGTTG | 56 | 1586 |
| 455288 | 74896 | 74915 | ATCAAGTCCAGGGAGAAAGG | 55 | 1587 |
| 455289 | 74898 | 74917 | AGATCAAGTCCAGGGAGAAA | 69 | 1588 |
| 455290 | 74900 | 74919 | GCAGATCAAGTCCAGGGAGA | 80 | 1589 |
| 455291 | 74902 | 74921 | CAGCAGATCAAGTCCAGGGA | 90 | 1590 |
| 455292 | 74904 | 74923 | AACAGCAGATCAAGTCCAGG | 77 | 1591 |
| 455293 | 74906 | 74925 | GAAACAGCAGATCAAGTCCA | 81 | 1592 |
| 455294 | 74908 | 74927 | CTGAAACAGCAGATCAAGTC | 75 | 1593 |
| 455295 | 74910 | 74929 | CTCTGAAACAGCAGATCAAG | 76 | 1594 |
| 455296 | 74912 | 74931 | GCCTCTGAAACAGCAGATCA | 74 | 1595 |
| 455297 | 74914 | 74933 | TAGCCTCTGAAACAGCAGAT | 75 | 1596 |
| 455298 | 74916 | 74935 | CCTAGCCTCTGAAACAGCAG | 76 | 1597 |
| 455299 | 74918 | 74937 | AACCTAGCCTCTGAAACAGC | 83 | 1598 |
| 455300 | 74920 | 74939 | ACAACCTAGCCTCTGAAACA | 57 | 1599 |
| 455301 | 74922 | 74941 | AAACAACCTAGCCTCTGAAA | 72 | 1600 |
| 455302 | 74924 | 74943 | AGAAACAACCTAGCCTCTGA | 78 | 1601 |
| 455303 | 74926 | 74945 | ACAGAAACAACCTAGCCTCT | 69 | 1602 |
| 455304 | 74928 | 74947 | CCACAGAAACAACCTAGCCT | 70 | 1603 |
| 455305 | 74930 | 74949 | ACCCACAGAAACAACCTAGC | 80 | 1604 |
| 455306 | 74932 | 74951 | GCACCCACAGAAACAACCTA | 70 | 1605 |
| 455307 | 74934 | 74953 | AGGCACCCACAGAAACAACC | 75 | 1606 |
| 455308 | 74936 | 74955 | TAAGGCACCCACAGAAACAA | 70 | 1607 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455309 | 74938 | 74957 | GATAAGGCACCCACAGAAAC | 65 | 1608 |
| 455310 | 74940 | 74959 | CTGATAAGGCACCCACAGAA | 66 | 1609 |
| 455311 | 74942 | 74961 | CCCTGATAAGGCACCCACAG | 81 | 1610 |
| 455312 | 74944 | 74963 | AGCCCTGATAAGGCACCCAC | 79 | 1611 |
| 455313 | 74946 | 74965 | CCAGCCCTGATAAGGCACCC | 74 | 1612 |
| 455314 | 74948 | 74967 | TCCCAGCCCTGATAAGGCAC | 74 | 1613 |
| 455315 | 74950 | 74969 | TATCCCAGCCCTGATAAGGC | 66 | 1614 |
| 455316 | 74952 | 74971 | AGTATCCCAGCCCTGATAAG | 48 | 1615 |
| 455317 | 74954 | 74973 | GAAGTATCCCAGCCCTGATA | 63 | 1616 |
| 455318 | 74956 | 74975 | CAGAAGTATCCCAGCCCTGA | 82 | 1617 |
| 455319 | 74958 | 74977 | ATCAGAAGTATCCCAGCCCT | 80 | 1618 |
| 455320 | 75066 | 75085 | GATTCCTAAAACAAACAGGA | 37 | 1619 |
| 455321 | 75068 | 75087 | AGGATTCCTAAAACAAACAG | 42 | 1620 |
| 455322 | 75070 | 75089 | CCAGGATTCCTAAAACAAAC | 72 | 1621 |
| 455323 | 75072 | 75091 | GACCAGGATTCCTAAAACAA | 71 | 1622 |
| 455324 | 75074 | 75093 | GAGACCAGGATTCCTAAAAC | 43 | 1623 |
| 455325 | 75076 | 75095 | CTGAGACCAGGATTCCTAAA | 77 | 1624 |
| 455326 | 75078 | 75097 | TCCTGAGACCAGGATTCCTA | 76 | 1625 |
| 455327 | 75080 | 75099 | GGTCCTGAGACCAGGATTCC | 69 | 1626 |
| 455328 | 75082 | 75101 | GAGGTCCTGAGACCAGGATT | 76 | 1627 |
| 455329 | 75084 | 75103 | ATGAGGTCCTGAGACCAGGA | 81 | 1628 |
| 455330 | 75086 | 75105 | CCATGAGGTCCTGAGACCAG | 84 | 1629 |
| 455331 | 75088 | 75107 | TTCCATGAGGTCCTGAGACC | 75 | 1630 |
| 455332 | 75090 | 75109 | TCTTCCATGAGGTCCTGAGA | 75 | 1631 |
| 455333 | 75092 | 75111 | CTTCTTCCATGAGGTCCTGA | 79 | 1632 |
| 455334 | 75094 | 75113 | CTCTTCTTCCATGAGGTCCT | 83 | 1633 |
| 455335 | 75096 | 75115 | CCCTCTTCTTCCATGAGGTC | 74 | 1634 |
| 455336 | 75098 | 75117 | CCCCCTCTTCTTCCATGAGG | 72 | 1635 |
| 455337 | 75100 | 75119 | CTCCCCCTCTTCTTCCATGA | 72 | 1636 |
| 455338 | 75164 | 75183 | CCTGAGCTCAACCAGACACG | 79 | 1637 |
| 455339 | 75166 | 75185 | TCCCTGAGCTCAACCAGACA | 73 | 1638 |
| 455340 | 75168 | 75187 | ATTCCCTGAGCTCAACCAGA | 75 | 1639 |
| 455341 | 75170 | 75189 | ATATTCCCTGAGCTCAACCA | 65 | 1640 |
| 455342 | 75172 | 75191 | CCATATTCCCTGAGCTCAAC | 78 | 1641 |
| 455343 | 75174 | 75193 | AACCATATTCCCTGAGCTCA | 81 | 1642 |
| 455344 | 75176 | 75195 | AGAACCATATTCCCTGAGCT | 77 | 1643 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455345 | 75178 | 75197 | TAAGAACCATATTCCCTGAG | 73 | 1644 |
| 455346 | 75180 | 75199 | GCTAAGAACCATATTCCCTG | 81 | 1645 |
| 455347 | 75254 | 75273 | TCAGTAAGCCTTTGCCCTGC | 79 | 1646 |
| 455348 | 75256 | 75275 | TATCAGTAAGCCTTTGCCCT | 72 | 1647 |
| 455349 | 75258 | 75277 | TTTATCAGTAAGCCTTTGCC | 76 | 1648 |
| 455350 | 75260 | 75279 | AGTTTATCAGTAAGCCTTTG | 84 | 1649 |
| 455351 | 75262 | 75281 | CAAGTTTATCAGTAAGCCTT | 82 | 1650 |
| 455352 | 75264 | 75283 | CTCAAGTTTATCAGTAAGCC | 82 | 1651 |
| 455353 | 75266 | 75285 | GACTCAAGTTTATCAGTAAG | 70 | 1652 |
| 455354 | 75268 | 75287 | CAGACTCAAGTTTATCAGTA | 78 | 1653 |
| 455355 | 75270 | 75289 | GGCAGACTCAAGTTTATCAG | 67 | 1654 |
| 455356 | 75272 | 75291 | AGGGCAGACTCAAGTTTATC | 51 | 1655 |
| 455357 | 75274 | 75293 | CGAGGGCAGACTCAAGTTTA | 54 | 1656 |
| 455358 | 75276 | 75295 | TACGAGGGCAGACTCAAGTT | 56 | 1657 |
| 455359 | 75278 | 75297 | CATACGAGGGCAGACTCAAG | 59 | 1658 |
| 455360 | 75280 | 75299 | CTCATACGAGGGCAGACTCA | 74 | 1659 |
| 455361 | 75282 | 75301 | CCCTCATACGAGGGCAGACT | 67 | 1660 |
| 455362 | 75309 | 75328 | CAGCCTCAGAGGGAGGCCAG | 40 | 1661 |
| 455363 | 75311 | 75330 | ACCAGCCTCAGAGGGAGGCC | 34 | 1662 |
| 455364 | 75313 | 75332 | TCACCAGCCTCAGAGGGAGG | 49 | 1663 |
| 455365 | 75315 | 75334 | AGTCACCAGCCTCAGAGGGA | 50 | 1664 |
| 455366 | 75412 | 75431 | CCCATACGCACAGGAGAGGC | 81 | 1665 |
| 455367 | 75414 | 75433 | TTCCCATACGCACAGGAGAG | 72 | 1666 |
| 455368 | 75416 | 75435 | TGTTCCCATACGCACAGGAG | 80 | 1667 |
| 455369 | 75418 | 75437 | GGTGTTCCCATACGCACAGG | 76 | 1668 |
| 455370 | 75420 | 75439 | TAGGTGTTCCCATACGCACA | 87 | 1669 |
| 455371 | 75422 | 75441 | GCTAGGTGTTCCCATACGCA | 92 | 1670 |
| 455372 | 75424 | 75443 | GTGCTAGGTGTTCCCATACG | 81 | 1671 |
| 455373 | 75491 | 75510 | GAGGCAAGGTGGTTTTGAGT | 55 | 1672 |
| 455374 | 75493 | 75512 | CTGAGGCAAGGTGGTTTTGA | 74 | 1673 |
| 455375 | 75495 | 75514 | AGCTGAGGCAAGGTGGTTTT | 79 | 1674 |
| 455376 | 75497 | 75516 | TCAGCTGAGGCAAGGTGGTT | 80 | 1675 |
| 455377 | 75499 | 75518 | GATCAGCTGAGGCAAGGTGG | 77 | 1676 |
| 455378 | 75501 | 75520 | CTGATCAGCTGAGGCAAGGT | 60 | 1677 |
| 455379 | 75503 | 75522 | CTCTGATCAGCTGAGGCAAG | 74 | 1678 |
| 455380 | 75505 | 75524 | AACTCTGATCAGCTGAGGCA | 77 | 1679 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455381 | 75507 | 75526 | GAAACTCTGATCAGCTGAGG | 78 | 1680 |
| 455382 | 75509 | 75528 | CAGAAACTCTGATCAGCTGA | 78 | 1681 |
| 455383 | 75547 | 75566 | CAGAGACCAGCTAATTTGAT | 69 | 1682 |
| 455384 | 75549 | 75568 | TTCAGAGACCAGCTAATTTG | 78 | 1683 |
| 455385 | 75551 | 75570 | AATTCAGAGACCAGCTAATT | 77 | 1684 |
| 455386 | 75553 | 75572 | TTAATTCAGAGACCAGCTAA | 83 | 1685 |
| 455387 | 75610 | 75629 | CTCCAGGCAGGAGGACTGGG | 79 | 1686 |
| 455388 | 75612 | 75631 | GTCTCCAGGCAGGAGGACTG | 65 | 1687 |
| 455389 | 75614 | 75633 | CTGTCTCCAGGCAGGAGGAC | 57 | 1688 |
| 455390 | 75616 | 75635 | AACTGTCTCCAGGCAGGAGG | 75 | 1689 |
| 455391 | 75618 | 75637 | TCAACTGTCTCCAGGCAGGA | 86 | 1690 |
| 455392 | 75620 | 75639 | CATCAACTGTCTCCAGGCAG | 80 | 1691 |
| 455393 | 75622 | 75641 | CACATCAACTGTCTCCAGGC | 86 | 1692 |
| 455394 | 75624 | 75643 | GACACATCAACTGTCTCCAG | 85 | 1693 |
| 455395 | 75658 | 75677 | GAAGAGTGTTGCTGGAGAAG | 73 | 1694 |
| 455396 | 75660 | 75679 | CTGAAGAGTGTTGCTGGAGA | 78 | 1695 |
| 455397 | 75662 | 75681 | TACTGAAGAGTGTTGCTGGA | 83 | 1696 |
| 455398 | 75664 | 75683 | TGTACTGAAGAGTGTTGCTG | 86 | 1697 |
| 455399 | 75666 | 75685 | TATGTACTGAAGAGTGTTGC | 74 | 1698 |
| 455400 | 75668 | 75687 | ATTATGTACTGAAGAGTGTT | 74 | 1699 |
| 455401 | 75670 | 75689 | TTATTATGTACTGAAGAGTG | 84 | 1700 |
| 455402 | 75672 | 75691 | GCTTATTATGTACTGAAGAG | 84 | 1701 |
| 455403 | 75674 | 75693 | AAGCTTATTATGTACTGAAG | 77 | 1702 |
| 455404 | 75676 | 75695 | TTAAGCTTATTATGTACTGA | 75 | 1703 |
| 455405 | 75678 | 75697 | AGTTAAGCTTATTATGTACT | 81 | 1704 |
| 455406 | 75680 | 75699 | TCAGTTAAGCTTATTATGTA | 58 | 1705 |
| 455407 | 75682 | 75701 | TATCAGTTAAGCTTATTATG | 65 | 1706 |
| 455408 | 75684 | 75703 | TTTATCAGTTAAGCTTATTA | 46 | 1707 |
| 455409 | 75686 | 75705 | TGTTTATCAGTTAAGCTTAT | 68 | 1708 |
| 455410 | 75688 | 75707 | TCTGTTTATCAGTTAAGCTT | 83 | 1709 |
| 455411 | 75726 | 75745 | AACCCAATGGTAAGCCCAAG | 87 | 1710 |
| 455412 | 75728 | 75747 | TAAACCCAATGGTAAGCCCA | 87 | 1711 |
| 455413 | 75730 | 75749 | TTTAAACCCAATGGTAAGCC | 78 | 1712 |
| 455414 | 75732 | 75751 | GATTTAAACCCAATGGTAAG | 31 | 1713 |
| 455415 | 75734 | 75753 | ATGATTTAAACCCAATGGTA | 71 | 1714 |
| 455416 | 75736 | 75755 | CTATGATTTAAACCCAATGG | 67 | 1715 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455417 | 75738 | 75757 | CCCTATGATTTAAACCCAAT | 70 | 1716 |
| 455418 | 75740 | 75759 | GTCCCTATGATTTAAACCCA | 83 | 1717 |
| 455419 | 75742 | 75761 | AGGTCCCTATGATTTAAACC | 64 | 1718 |
| 455420 | 75776 | 75795 | TATCTGCTCCAGAGAAGCCC | 76 | 1719 |
| 455421 | 75778 | 75797 | AATATCTGCTCCAGAGAAGC | 78 | 1720 |
| 455422 | 75801 | 75820 | CTACCTAAGGCCATGAACTT | 74 | 1721 |
| 455423 | 75803 | 75822 | TGCTACCTAAGGCCATGAAC | 82 | 1722 |
| 455424 | 75805 | 75824 | CATGCTACCTAAGGCCATGA | 84 | 1723 |
| 455425 | 75823 | 75842 | CAGAGTTAAGACCAGATACA | 84 | 1724 |
| 455426 | 75825 | 75844 | ATCAGAGTTAAGACCAGATA | 83 | 1725 |
| 455427 | 75827 | 75846 | CAATCAGAGTTAAGACCAGA | 77 | 1726 |
| 455428 | 75829 | 75848 | TACAATCAGAGTTAAGACCA | 81 | 1727 |
| 455429 | 75831 | 75850 | GCTACAATCAGAGTTAAGAC | 86 | 1728 |
| 455430 | 75833 | 75852 | TTGCTACAATCAGAGTTAAG | 85 | 1729 |
| 455431 | 75835 | 75854 | TTTTGCTACAATCAGAGTTA | 85 | 1730 |
| 455432 | 75837 | 75856 | ACTTTTGCTACAATCAGAGT | 73 | 1731 |
| 455433 | 75839 | 75858 | GAACTTTTGCTACAATCAGA | 80 | 1732 |
| 455434 | 75841 | 75860 | CAGAACTTTTGCTACAATCA | 82 | 1733 |
| 455435 | 75843 | 75862 | CTCAGAACTTTTGCTACAAT | 79 | 1734 |
| 455436 | 75845 | 75864 | CTCTCAGAACTTTTGCTACA | 76 | 1735 |
| 455437 | 75847 | 75866 | TCCTCTCAGAACTTTTGCTA | 75 | 1736 |
| 455438 | 75849 | 75868 | GCTCCTCTCAGAACTTTTGC | 85 | 1737 |
| 455439 | 75851 | 75870 | CAGCTCCTCTCAGAACTTTT | 85 | 1738 |
| 455440 | 75853 | 75872 | CTCAGCTCCTCTCAGAACTT | 80 | 1739 |
| 455441 | 75855 | 75874 | GGCTCAGCTCCTCTCAGAAC | 75 | 1740 |
| 455442 | 75957 | 75976 | GCAACCCACGGGATTCCCTC | 82 | 1741 |
| 455443 | 75959 | 75978 | AAGCAACCCACGGGATTCCC | 77 | 1742 |
| 455444 | 75961 | 75980 | GTAAGCAACCCACGGGATTC | 74 | 1743 |
| 455445 | 75963 | 75982 | AGGTAAGCAACCCACGGGAT | 76 | 1744 |
| 455446 | 75965 | 75984 | GTAGGTAAGCAACCCACGGG | 82 | 1745 |
| 455447 | 75967 | 75986 | AGGTAGGTAAGCAACCCACG | 88 | 1746 |
| 455448 | 75969 | 75988 | ATAGGTAGGTAAGCAACCCA | 83 | 1747 |
| 455449 | 75971 | 75990 | TTATAGGTAGGTAAGCAACC | 59 | 1748 |
| 455450 | 75973 | 75992 | CCTTATAGGTAGGTAAGCAA | 65 | 1749 |
| 455451 | 75975 | 75994 | CACCTTATAGGTAGGTAAGC | 62 | 1750 |
| 455452 | 75977 | 75996 | ACCACCTTATAGGTAGGTAA | 57 | 1751 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455453 | 75979 | 75998 | AAACCACCTTATAGGTAGGT | 75 | 1752 |
| 455454 | 75981 | 76000 | ATAAACCACCTTATAGGTAG | 35 | 1753 |
| 455455 | 75983 | 76002 | TTATAAACCACCTTATAGGT | 39 | 1754 |
| 455456 | 75985 | 76004 | GCTTATAAACCACCTTATAG | 58 | 1755 |
| 455457 | 75987 | 76006 | CAGCTTATAAACCACCTTAT | 86 | 1756 |
| 455458 | 75989 | 76008 | AGCAGCTTATAAACCACCTT | 86 | 1757 |
| 455459 | 75991 | 76010 | ACAGCAGCTTATAAACCACC | 80 | 1758 |
| 455460 | 75993 | 76012 | GGACAGCAGCTTATAAACCA | 69 | 1759 |
| 455461 | 75995 | 76014 | CAGGACAGCAGCTTATAAAC | 72 | 1760 |
| 455462 | 75997 | 76016 | GCCAGGACAGCAGCTTATAA | 76 | 1761 |
| 455463 | 75999 | 76018 | TGGCCAGGACAGCAGCTTAT | 89 | 1762 |
| 455464 | 76001 | 76020 | AGTGGCCAGGACAGCAGCTT | 80 | 1763 |
| 455465 | 76003 | 76022 | GCAGTGGCCAGGACAGCAGC | 78 | 1764 |
| 455466 | 76005 | 76024 | ATGCAGTGGCCAGGACAGCA | 85 | 1765 |
| 455467 | 76007 | 76026 | GAATGCAGTGGCCAGGACAG | 80 | 1766 |
| 455468 | 76009 | 76028 | TTGAATGCAGTGGCCAGGAC | 83 | 1767 |
| 455469 | 76011 | 76030 | ATTTGAATGCAGTGGCCAGG | 84 | 1768 |
| 455470 | 76013 | 76032 | GAATTTGAATGCAGTGGCCA | 81 | 1769 |
| 455471 | 76015 | 76034 | TGGAATTTGAATGCAGTGGC | 85 | 1770 |
| 455472 | 76017 | 76036 | ATTGGAATTTGAATGCAGTG | 64 | 1771 |
| 455473 | 76019 | 76038 | ACATTGGAATTTGAATGCAG | 80 | 1772 |
| 455474 | 76021 | 76040 | ACACATTGGAATTTGAATGC | 73 | 1773 |
| 455475 | 76023 | 76042 | GTACACATTGGAATTTGAAT | 80 | 1774 |
| 455476 | 76025 | 76044 | AAGTACACATTGGAATTTGA | 77 | 1775 |
| 455477 | 76027 | 76046 | TGAAGTACACATTGGAATTT | 68 | 1776 |
| 455478 | 76029 | 76048 | TATGAAGTACACATTGGAAT | 66 | 1777 |
| 455479 | 76031 | 76050 | ACTATGAAGTACACATTGGA | 83 | 1778 |
| 455480 | 76033 | 76052 | ACACTATGAAGTACACATTG | 76 | 1779 |
| 455481 | 76035 | 76054 | TTACACTATGAAGTACACAT | 78 | 1780 |
| 455482 | 76037 | 76056 | TTTTACACTATGAAGTACAC | 76 | 1781 |
| 455483 | 76039 | 76058 | ATTTTTACACTATGAAGTAC | 60 | 1782 |
| 455484 | 76041 | 76060 | AAATTTTTACACTATGAAGT | 35 | 1783 |
| 455485 | 76043 | 76062 | ATAAATTTTTACACTATGAA | 9 | 1784 |
| 455486 | 76045 | 76064 | ATATAAATTTTTACACTATG | 0 | 1785 |
| 455487 | 76047 | 76066 | TAATATAAATTTTTACACTA | 21 | 1786 |
| 455488 | 76049 | 76068 | AATAATATAAATTTTTACAC | 10 | 1787 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455489 | 76051 | 76070 | ACAATAATATAAATTTTAC | 7 | 1788 |
| 455490 | 76112 | 76131 | AGTTAAAGTAGATACAGCAA | 71 | 1789 |
| 455491 | 76114 | 76133 | GAAGTTAAAGTAGATACAGC | 63 | 1790 |
| 455492 | 76116 | 76135 | TGGAAGTTAAAGTAGATACA | 69 | 1791 |
| 455493 | 76118 | 76137 | TCTGGAAGTTAAAGTAGATA | 65 | 1792 |
| 455494 | 76120 | 76139 | TTTCTGGAAGTTAAAGTAGA | 55 | 1793 |
| 455495 | 76122 | 76141 | TATTTCTGGAAGTTAAAGTA | 57 | 1794 |
| 455496 | 76124 | 76143 | TTTATTTCTGGAAGTTAAAG | 36 | 1795 |
| 455497 | 76126 | 76145 | CGTTTATTTCTGGAAGTTAA | 77 | 1796 |
| 455553 | 9123 11261 | 9142 11280 | ACCTGCCCCTATGTATAAGC | 89 | 1852 |
| 455554 | 9484 | 9503 | TTTGTAATATCTAACAGATA | 20 | 1853 |
| 455555 | 9630 | 9649 | TATATGACAGCCTCAATTTC | 68 | 1854 |
| 455556 | 9677 | 9696 | GGCATTTGTGTAAACAGGAA | 81 | 1855 |
| 455557 | 9746 | 9765 | TGTTAAATATTACTTAAAAT | 4 | 1856 |
| 455558 | 9776 | 9795 | AATTCCTTGGGTGGTAATCC | 81 | 1857 |
| 455559 | 10071 | 10090 | GGAAAGTTACAGGACAGGAA | 77 | 1858 |
| 455560 | 10352 | 10371 | GAAATGGCTTCTACAAAAAC | 47 | 1859 |
| 455561 | 10472 | 10491 | GGTCAGAATACCACAAACTA | 80 | 1860 |
| 455562 | 10634 | 10653 | AGTCTAATGCTTTTAGATTC | 59 | 1861 |
| 455563 | 11567 | 11586 | CATTGGAAAACTTAGGGTAA | 37 | 1862 |
| 455564 | 11597 | 11616 | ATTCTCACTGGGTATAGAGG | 72 | 1863 |
| 455565 | 11700 | 11719 | TAGCATTAATCTTTCCTAGG | 92 | 1864 |
| 455566 | 9886 12369 | 9905 12388 | GACTCAAAATAAGGTTCCTC | 86 | 1865 |
| 455567 | 12430 | 12449 | ACAGATTTATTCATATAAGC | 62 | 1866 |
| 455568 | 14060 | 14079 | AGATCCATAGATTCTTTCTT | 80 | 1867 |
| 455569 | 14129 | 14148 | ATCTGAATCAGAATATCTGC | 88 | 1868 |
| 455570 | 14190 | 14209 | GAAGACTTTATATTCTATGG | 59 | 1869 |
| 455571 | 14355 | 14374 | TATCCTTAATATTCAGGTAC | 82 | 1870 |
| 455572 | 14501 | 14520 | TTATTAAGACATCTGAAATA | 31 | 1871 |
| 455573 | 14701 | 14720 | TTAAGTGACTACACATGGAT | 76 | 1872 |
| 455574 | 14761 | 14780 | GATAATGTAACAACCCTATC | 42 | 1873 |
| 455575 | 14828 | 14847 | CTGAAGCATGAATTCACATT | 83 | 1874 |
| 455576 | 15316 | 15335 | AAATTCCACTACTCATGAAA | 62 | 1875 |
| 455577 | 15370 | 15389 | CTTCAGAGAATATCTCATTT | 83 | 1876 |
| 455578 | 15400 | 15419 | CACATCATAGTTTTGCATGA | 70 | 1877 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455579 | 15525 | 15544 | TCTGACCCATAAAGTTTAAA | 70 | 1878 |
| 455580 | 16568 | 16587 | TTGGTTAATAATAATGTATC | 44 | 1879 |
| 455581 | 16832 | 16851 | TCACACATTTGTCAAAATCC | 89 | 1880 |
| 455582 | 16863 | 16882 | TATATAATTGTGTACTGGCA | 93 | 1881 |
| 455583 | 16930 | 16949 | TGCCAGTGGTTCAGCAGAGG | 77 | 1882 |
| 455584 | 17215 | 17234 | AATGTTTATAGCAGCTTTAT | 56 | 1883 |
| 455585 | 17330 | 17349 | GTCACTTTGAATATAGTTTG | 79 | 1884 |
| 455586 | 17426 | 17445 | GGCTAAAATCCAAAACACTG | 65 | 1885 |
| 455587 | 18449 | 18468 | AACAGTATTTGAGAAAACTT | 21 | 1886 |
| 455588 | 19883 | 19902 | GGGCTACAACTCAATAACAA | 63 | 1887 |
| 455589 | 20512 | 20531 | AAGTCCTTATCATTTAGCTC | 69 | 1888 |
| 455590 | 21035 | 21054 | GATATTCCCAAAGTGACAGG | 75 | 1889 |
| 455591 | 21188 | 21207 | ATAATGAGACTTTAGCACTC | 86 | 1890 |
| 455592 | 21422 | 21441 | AATCTAAACTTCCAGCCAGG | 78 | 1891 |
| 455593 | 21493 | 21512 | ACAATAATGCATGCAAATGT | 67 | 1892 |
| 455594 | 21675 | 21694 | CACTGCTATTTCCCCAGCAA | 89 | 1893 |
| 455595 | 21710 | 21729 | CTTAAGCCCCATAAGAACAA | 65 | 1894 |
| 455596 | 21823 | 21842 | ATCTAAAACAGCAACATCTC | 57 | 1895 |
| 455597 | 23917 | 23936 | TAGTGATTGAATGTAGACTT | 81 | 1896 |
| 455598 | 23980 | 23999 | TTAGGCCACTAAGTCTGAGC | 83 | 1897 |
| 455599 | 24178 | 24197 | CAGCTGAAATCAGCCTTTGA | 69 | 1898 |
| 455600 | 24345 | 24364 | AATCTAGCTAAGTCCATAAC | 43 | 1899 |
| 455601 | 24504 | 24523 | TGCTTGGATATATAGAAGTC | 80 | 1900 |
| 455602 | 24578 | 24597 | AGGTCACTTTCCCTATACGA | 81 | 1901 |
| 455603 | 24608 | 24627 | AGAAGGAAGATTCTTTTCTC | 73 | 1902 |
| 455604 | 24924 | 24943 | CTAAGAGAGGCAACTGAAAT | 60 | 1903 |
| 455605 | 25063 | 25082 | GGCTCGAGGGCCACTGAAGG | 59 | 1904 |
| 455606 | 25093 | 25112 | AGCAAGCACATTGTCATGTC | 83 | 1905 |
| 455607 | 25132 | 25151 | GGCTGCCAAACTTTTCAAAA | 76 | 1906 |
| 455608 | 25626 | 25645 | TTTGTTCTTGCCTAAAATGC | 45 | 1907 |
| 455609 | 25688 | 25707 | TTCCTTCAAGTCAACTTATC | 69 | 1908 |
| 455610 | 26031 | 26050 | CCAGCCTACAGATGACTTTC | 78 | 1909 |
| 455611 | 26061 | 26080 | GCCAACTTTAGCCCCTTCCA | 85 | 1910 |
| 455612 | 26104 | 26123 | AATGCAAAATCTTTACCCTT | 58 | 1911 |
| 455613 | 26139 | 26158 | CCAGCTCAAAAACACACACT | 80 | 1912 |
| 455614 | 26227 | 26246 | GTTTGAAAAATTCAAGAATG | 26 | 1913 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455615 | 26388 | 26407 | ATAGTGTCTGGCTCATAATA | 48 | 1914 |
| 455616 | 26597 | 26616 | TCAGGTCCTCAAAAACACCA | 84 | 1915 |
| 455617 | 26648 | 26667 | TGGCTGGTACCAGCTGGTGG | 76 | 1916 |
| 455618 | 26766 | 26785 | ACAAATTCATCGAGCTAATG | 52 | 1917 |
| 455619 | 26908 | 26927 | AGAATAGCATGGATTTGAAT | 49 | 1918 |
| 455620 | 26999 | 27018 | CACAAACTTGATCTTGCCAC | 77 | 1919 |
| 455626 | 36534 | 36553 | GAATGTAAAGTATCTTGTTC | 47 | 1920 |
| 455627 | 36578 | 36597 | TATAAAATACACACTGGATT | 57 | 1921 |
| 455628 | 36614 | 36633 | GAAATGTGGCTGCTTCAAAC | 36 | 1922 |
| 455629 | 36649 | 36668 | TGGAGTCACTAGCCACATGT | 71 | 1923 |
| 455630 | 36691 | 36710 | GCATACAAATTTACTGAAAC | 58 | 1924 |
| 455631 | 36904 | 36923 | CAAGTTAAAATCTGCCTCAC | 62 | 1925 |
| 455632 | 36975 | 36994 | GGCATGTATTGATTGCCCTC | 68 | 1926 |
| 455633 | 37026 | 37045 | AGTAAAAGCAGTGGCTGACG | 60 | 1927 |
| 455634 | 37086 | 37105 | CACCTGCCACAGGACAAATG | 28 | 1928 |
| 455635 | 37755 | 37774 | TTGCCCCAATTAGGCCAATA | 76 | 1929 |
| 455636 | 37822 | 37841 | AAGGGCTTAAATTCCACTGG | 73 | 1930 |
| 455637 | 37873 | 37892 | GTACTTTACATGTGCAGCAC | 81 | 1931 |
| 455638 | 38268 | 38287 | AATATATCCAAAATGTTATT | 8 | 1932 |
| 455639 | 38694 | 38713 | GCAGCATCCAACAGAAATAG | 62 | 1933 |
| 455640 | 39294 | 39313 | GAGACTGAACACACGCAAAC | 65 | 1934 |
| 455641 | 39324 | 39343 | GTTCTCTGGGATAGTGAGAA | 49 | 1935 |
| 455642 | 39792 | 39811 | GAGAAACCCAGCCAGCTAAT | 69 | 1936 |
| 455643 | 39937 | 39956 | GGAAGATCTGCCTGAGATTC | 46 | 1937 |
| 455644 | 40132 | 40151 | TACAGCATCCAGCTCAGTGC | 63 | 1938 |
| 455645 | 40633 | 40652 | CCCAGTTTAGAACAATACAA | 65 | 1939 |
| 455646 | 40866 | 40885 | GTAGCCATTGCCCAACACAG | 63 | 1940 |
| 455647 | 40901 | 40920 | CACCACAAGTCCCAGTAGGG | 58 | 1941 |
| 455648 | 40923 | 40942 | TAAACCAAAGTGTGCATATG | 11 | 1942 |
| 455649 | 41087 | 41106 | AAGGACTTACCAATCTTGAC | 7 | 1943 |
| 455650 | 41114 | 41133 | ACCTAACAATTTGGAGAGTC | 44 | 1944 |
| 455651 | 41239 | 41258 | TTACAAGACCAAAGGGTGCC | 68 | 1945 |
| 455652 | 41329 | 41348 | AAATCAACCTTCAAGACATC | 13 | 1946 |
| 455653 | 41397 | 41416 | AAAAATATGTCTACCACATC | 52 | 1947 |
| 455654 | 41431 | 41450 | AAGTTCTAGCTATGACAGAA | 23 | 1948 |
| 455655 | 41575 | 41594 | AGCCTGCAGAACTATGAGCC | 48 | 1949 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455656 | 41629 | 41648 | ATTGGAAGCTTGCTGAGGCC | 44 | 1950 |
| 455657 | 41644 | 41663 | CTGCCTTCCGCCATGATTGG | 48 | 1951 |
| 455658 | 41747 | 41766 | CGAGACAGTGAGTTCTTGTG | 64 | 1952 |
| 455659 | 42067 | 42086 | CTGGCCCTTCACCAAATCAG | 62 | 1953 |
| 455660 | 42139 | 42158 | GGTCAGATTTATTAGTACAA | 65 | 1954 |
| 455661 | 42904 | 42923 | ATCATACCTGAAGAAACTGC | 16 | 1955 |
| 455662 | 43059 | 43078 | ATACAGAGCTTTGAGAAAGG | 38 | 1956 |
| 455663 | 43194 | 43213 | TGTAACAGTGAGAGTCATCT | 71 | 1957 |
| 455664 | 43284 | 43303 | TCTGAGTCTTTACACAGTAT | 72 | 1958 |
| 455665 | 43724 | 43743 | TTCATCAAGGAAAGCATTTA | 31 | 1959 |
| 455666 | 43765 | 43784 | TGGAGATGTGGACTGAACTG | 19 | 1960 |
| 455667 | 43908 | 43927 | CCTGGGCCGCAGTGGCTGCA | 63 | 1961 |
| 455668 | 43926 | 43945 | GTTTTGTCTCAGGTCTCACC | 75 | 1962 |
| 455669 | 43941 | 43960 | CCAGACCAGGGATTTGTTTT | 34 | 1963 |
| 455670 | 43974 | 43993 | CTCATTATAAAGTTGTTTGA | 55 | 1964 |
| 455671 | 44507 | 44526 | TGTACTATGAAAGTTTGTCA | 80 | 1965 |
| 455672 | 44525 | 44544 | AATGATATTGGAATAATCTG | 26 | 1966 |
| 455673 | 44540 | 44559 | CTTTGGAAAAGTTTGAATGA | 26 | 1967 |
| 455674 | 44583 | 44602 | CAGCCTCATAAAATAAGCTG | 19 | 1968 |
| 455675 | 45414 | 45433 | TACTGAGAATAGTGTTTCAC | 71 | 1969 |
| 455676 | 45440 | 45459 | AAGACATCCTTATCTTTTGC | 75 | 1970 |
| 455677 | 45512 | 45531 | TTCCAATATTTGTACCCTCA | 87 | 1971 |
| 455678 | 45626 | 45645 | TACAATGGCCTTTCTAAACC | 64 | 1972 |
| 455679 | 45712 | 45731 | AGATCTTTACTTTCATTACA | 54 | 1973 |
| 455680 | 46058 | 46077 | TATGCAAATTGCATACATTT | 59 | 1974 |
| 455681 | 46091 | 46110 | TTTCCAGATATTTTCCCATA | 88 | 1975 |
| 455682 | 46241 | 46260 | GTGTATTTCACCACAATTTT | 78 | 1976 |
| 455683 | 46571 | 46590 | TGTCTTTGAACATGATCTTC | 67 | 1977 |
| 455684 | 46676 | 46695 | GCATGACTAATTAAAACATC | 58 | 1978 |
| 455685 | 46759 | 46778 | CAGAGCAAGTGGCAGGGCTG | 69 | 1979 |
| 455686 | 46791 | 46810 | CAGAGAGAGTAAAAATTGTT | 49 | 1980 |
| 455687 | 46905 | 46924 | CAGCAGAAAGCAGTTAAATT | 56 | 1981 |
| 455688 | 46941 | 46960 | CAGTAATGGTGAGGGTGATG | 28 | 1982 |
| 455689 | 46956 | 46975 | GGTCCCCATTTCCTACAGTA | 67 | 1983 |
| 455690 | 47307 | 47326 | ACACCTGAGCATATCAGTTT | 67 | 1984 |
| 455691 | 47400 | 47419 | CAGAAAATCCTAGTGCTGCC | 62 | 1985 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455692 | 47424 | 47443 | ATAAAATACAAAGGTTTTCC | 23 | 1986 |
| 455693 | 47467 | 47486 | TCCAAATTGACTTAAACCAC | 74 | 1987 |
| 455694 | 47528 | 47547 | TTGAAAACATCCTTGGGATA | 44 | 1988 |
| 455695 | 47579 | 47598 | CAGGCTGGATTTGGGCCACG | 76 | 1989 |
| 455696 | 47649 | 47668 | GCCACAGATAATGCATAAAT | 39 | 1990 |
| 455697 | 47795 | 47814 | CTGGGTTGAGGCCACAAATA | 78 | 1991 |
| 455698 | 47929 | 47948 | GTTTGTGTACTTATAATCCC | 75 | 1992 |
| 455699 | 47974 | 47993 | GACAAAATGACACACATCCT | 72 | 1993 |
| 455700 | 48188 | 48207 | TTTCACACAATTGATAACTT | 57 | 1994 |
| 455701 | 48208 | 48227 | CAGGCCAACACAGAAAGCTG | 70 | 1995 |
| 455702 | 48277 | 48296 | AGAAACCCACCTCTAATACC | 31 | 1996 |
| 455703 | 48402 | 48421 | GCCACACTTTCCATTCTAGT | 90 | 1997 |
| 455704 | 48417 | 48436 | TGGTTACCAGCTCAAGCCAC | 72 | 1998 |
| 455705 | 48566 | 48585 | CAGGTCTAGAGGCCTATCCC | 73 | 1999 |
| 455706 | 48665 | 48684 | TCTTCAAAGAACCCAGCACC | 63 | 2000 |
| 455707 | 48697 | 48716 | AGATGGAGAGAAAGACTCTG | 61 | 2001 |
| 455708 | 48728 | 48747 | CCCACAGTGACAGTGACTCA | 89 | 2002 |
| 455709 | 48768 | 48787 | CTTAGAAGTTTTGGGAAGGT | 60 | 2003 |
| 455710 | 48802 | 48821 | ATGGTCCCTATCCAAGCCCA | 81 | 2004 |
| 455711 | 48828 | 48847 | ATGGGCAACCATTCTCTTCC | 80 | 2005 |
| 455712 | 49754 | 49773 | GTTGGATGTCTACTTAAACG | 63 | 2006 |
| 455713 | 49845 | 49864 | GACCACATGTTCAGCTAAGA | 68 | 2007 |
| 455714 | 49923 | 49942 | AAACAGAGGCAGTGGTGCTG | 62 | 2008 |
| 455715 | 50053 | 50072 | CCAAAAAGGAGGTCAATGCA | 30 | 2009 |
| 455716 | 50522 | 50541 | GTATCCCCAAGAGAAGGCTC | 59 | 2010 |
| 455717 | 50571 | 50590 | TCAAATGAAGCCAAAACCTC | 63 | 2011 |
| 455718 | 50774 | 50793 | CACTTTCTAGAGATTTTAAC | 1 | 2012 |
| 455719 | 51623 | 51642 | TCAGATCTTGCATGTCTGCG | 2 | 2013 |
| 455720 | 51753 | 51772 | CCGCAAGTGAGCGAGACACA | 49 | 2014 |
| 455721 | 51827 | 51846 | CCACATTCTTTAGTCAACTC | 59 | 2015 |
| 455722 | 51856 | 51875 | CAGAAAACATTTCCTCAGAC | 3 | 2016 |
| 455723 | 52033 | 52052 | ACCAGTTTTCTAGCCGATCT | 90 | 2017 |
| 455724 | 52056 | 52075 | AGGAAAAGCTTCTTTCATCC | 34 | 2018 |
| 455725 | 52071 | 52090 | GCTTTCGAGAAAGAAAGGAA | 44 | 2019 |
| 455726 | 53203 | 53222 | TGGATGAAGGTAAAAGTGCA | 42 | 2020 |
| 455727 | 53246 | 53265 | TCACTATAGGGCCTTGCACA | 53 | 2021 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455728 | 53262 | 53281 | AGCTGGTGCAACATGCTCAC | 69 | 2022 |
| 455729 | 53329 | 53348 | GCATTCTCATGTAGAGTTGC | 0 | 2023 |
| 455730 | 53344 | 53363 | GATATGAATAGACAGGCATT | 63 | 2024 |
| 455731 | 53431 | 53450 | ATTCCCAGAACTTAAGCTTC | 40 | 2025 |
| 455732 | 53571 | 53590 | ATTCCATCATTCTTTGATGG | 47 | 2026 |
| 455733 | 53900 | 53919 | TGCACAAGGAATAAGTGAAT | 51 | 2027 |
| 455734 | 54378 | 54397 | AGAAGGGCTTGAACTACATG | 15 | 2028 |
| 455735 | 54577 | 54596 | GAGCCCAGATATGCAGAACA | 58 | 2029 |
| 455736 | 54592 | 54611 | AAATGACAAGCATCTGAGCC | 16 | 2030 |
| 455737 | 54632 | 54651 | ATTTATACCACTAGGAGGCA | 52 | 2031 |
| 455738 | 55241 | 55260 | TTCAGTGACATTAAGAAAAG | 28 | 2032 |
| 455739 | 55256 | 55275 | ATCTTAAGTTTACAGTTCAG | 64 | 2033 |
| 455740 | 55277 | 55296 | GCATGAAATTTACAATTTTT | 26 | 2034 |
| 455741 | 55418 | 55437 | TCCTGCCAATAAATTAAGAA | 0 | 2035 |
| 455742 | 55657 | 55676 | GAAGTCAGCCCGCCTCTCAC | 33 | 2036 |
| 455743 | 55841 | 55860 | GTGTCCCTCAGTAAAATCTC | 53 | 2037 |
| 455744 | 55877 | 55896 | ATGACCCTGGCCACCAACTC | 63 | 2038 |
| 455745 | 55961 | 55980 | CAGAATCAGAGAGCAAGCAG | 56 | 2039 |
| 455746 | 56125 | 56144 | CCTTAAAATCCACAGGGAAG | 5 | 2040 |
| 455747 | 56151 | 56170 | TCCCCATCACTAAGCCTTAC | 31 | 2041 |
| 455748 | 56203 | 56222 | TAACACCTCACCCTACAGGC | 56 | 2042 |
| 455749 | 56287 | 56306 | ACACCATACTAAGTTTCTGA | 68 | 2043 |
| 455750 | 57995 | 58014 | CTTGTCAATGCACACTTTAA | 80 | 2044 |
| 455751 | 58074 | 58093 | TCTAGTTCAAATGATGTCTG | 66 | 2045 |
| 455752 | 58089 | 58108 | AATAAAGACAGAGTCTCTAG | 30 | 2046 |
| 455753 | 58106 | 58125 | CAAAATGAAGATCTCTGAAT | 23 | 2047 |
| 455754 | 58173 | 58192 | AGCTTTGTGGCTTTGTTCAG | 60 | 2048 |
| 455755 | 58259 | 58278 | TGAATGACATGTACAAGTAA | 52 | 2049 |
| 455756 | 58377 | 58396 | TGTGTAAGGACTATATACTC | 64 | 2050 |
| 455757 | 58471 | 58490 | TTCAGCACAGTAACATACTG | 41 | 2051 |
| 455758 | 58496 | 58515 | AGATGTGTTACAATTGCCTA | 76 | 2052 |
| 455759 | 58696 | 58715 | TTTACATCCTGAAAGGTATT | 51 | 2053 |
| 455760 | 59471 | 59490 | ATATGTACTTATTAAACCTA | 18 | 2054 |
| 455761 | 59748 | 59767 | ACAAAAGGAAGCCTCTAGGC | 0 | 2055 |
| 455762 | 59913 | 59932 | CCAAGTGTTTGAATTCTGCA | 83 | 2056 |
| 455763 | 60155 | 60174 | CAGGTTGATGTTTCTAATTC | 60 | 2057 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455764 | 60170 | 60189 | CTACAGCTGAAAGAACAGGT | 76 | 2058 |
| 455765 | 60249 | 60268 | ATGTTCCAAGCCAGAGAGCT | 54 | 2059 |
| 455766 | 60323 | 60342 | GGTGTGGAGAACAACTCAGC | 72 | 2060 |
| 455767 | 60373 | 60392 | GGGAATTTGGAAAGCCCCAG | 0 | 2061 |
| 455768 | 60392 | 60411 | CAGCCGCAGGAGCTGGATGG | 42 | 2062 |
| 455769 | 60407 | 60426 | GGAGCCAAGCAGGGTCAGCC | 73 | 2063 |
| 455770 | 60433 | 60452 | GGAGAGAAAAACAGGGCACT | 69 | 2064 |
| 455771 | 60448 | 60467 | TATCCCACCTCAGTGGGAGA | 1 | 2065 |
| 455772 | 60602 | 60621 | TCTGAATCAATGAAAAGCAG | 79 | 2066 |
| 455773 | 60703 | 60722 | CATCACAATTTTTAAAAATG | 0 | 2067 |
| 455774 | 61216 | 61235 | GTATTTTAAAACACATATA | 0 | 2068 |
| 455775 | 61251 | 61270 | CTTAATATACATATGAATAC | 14 | 2069 |
| 455786 | 61340 | 61359 | CAAATATCACAGAGACAGTC | 88 | 2070 |
| 455787 | 61758 | 61777 | GTACAGCAACCTTATTTTAA | 5 | 2071 |
| 455788 | 61853 | 61872 | TTAAATCCTGGGAATGGCAC | 83 | 2072 |
| 455789 | 61959 | 61978 | CTAATGTTGATGGGTATTTA | 60 | 2073 |
| 455790 | 62043 | 62062 | CATGGTTATGTGTATCTGCA | 89 | 2074 |
| 455791 | 62067 | 62086 | TTCACTTGATGTGAAATGAA | 18 | 2075 |
| 455792 | 62500 | 62519 | TGCCAGGGACACAACTTGCT | 82 | 2076 |
| 455793 | 62595 | 62614 | ATGGCATTCAGTACTAACAG | 59 | 2077 |
| 455794 | 62610 | 62629 | TTTTCCTCAGAGAGAATGGC | 67 | 2078 |
| 455795 | 63284 | 63303 | AGTCACAATCAGGGAAGCCT | 77 | 2079 |
| 455796 | 63449 | 63468 | AGTAATCATTCCACCTTCTC | 70 | 2080 |
| 455797 | 63464 | 63483 | CAGTGTTAAGCAAACAGTAA | 41 | 2081 |
| 455798 | 63554 | 63573 | ATACACACATCTTCTAAGCA | 48 | 2082 |
| 455799 | 63576 | 63595 | TCAAGTTTGCTGAAAGCTGA | 48 | 2083 |
| 455800 | 63591 | 63610 | ATAGAGATTTTCATATCAAG | 41 | 2084 |
| 455801 | 64070 | 64089 | ACAGGGAGGTCTCAGGAATC | 77 | 2085 |
| 455802 | 64122 | 64141 | TTTAAGACCTTGGAGGCATT | 36 | 2086 |
| 455803 | 64586 | 64605 | AGGGATGGTGCTCATTGTCT | 20 | 2087 |
| 455804 | 64810 | 64829 | GCCGGATCCCTTTTCTGGGC | 64 | 2088 |
| 455805 | 64955 | 64974 | TGATCACCTCGACTGAAAAC | 65 | 2089 |
| 455806 | 65058 | 65077 | GTGCCACCTTCCAACACACA | 74 | 2090 |
| 455807 | 65530 | 65549 | CAGACAGGTGTATTTGGTGG | 65 | 2091 |
| 455808 | 65895 | 65914 | ACTTTGCAAAATTTAGCCCA | 77 | 2092 |
| 455809 | 65928 | 65947 | TCCCATTCCCACGAGAATTT | 76 | 2093 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455810 | 65972 | 65991 | GCCTTCAAGCCAGAGCCCTC | 76 | 2094 |
| 455811 | 65987 | 66006 | GACCAAGAGTTCAGGGCCTT | 59 | 2095 |
| 455812 | 66099 | 66118 | GTAATGGGAAAGCCAAGTCT | 51 | 2096 |
| 455813 | 66128 | 66147 | TTGCCAGCCATGTTTTCCTG | 67 | 2097 |
| 455814 | 66283 | 66302 | AGGGCATCCATCCCCTGCCA | 7 | 2098 |
| 455815 | 66664 | 66683 | TCACTGGAGCAAGCAAAACA | 64 | 2099 |
| 455816 | 66775 | 66794 | GGTCATAGAAAATAAACTTG | 62 | 2100 |
| 455817 | 66863 | 66882 | AGTGTTGAGACCCTGAACAC | 53 | 2101 |
| 455818 | 66918 | 66937 | AGAGAAAACTGCCCATTTTT | 71 | 2102 |
| 455819 | 66948 | 66967 | AGATCATGGAACCTACAGCT | 18 | 2103 |
| 455820 | 66963 | 66982 | GGACATGGGAAGGAAAGATC | 27 | 2104 |
| 455821 | 67191 | 67210 | CAACAACTACCTGGGTCAGC | 51 | 2105 |
| 455822 | 67271 | 67290 | AGGCATTTGCCTATCTATCC | 58 | 2106 |
| 455823 | 67334 | 67353 | CCAACAAAAGCACTCACTAC | 56 | 2107 |
| 455824 | 67773 | 67792 | TGAAATCTGGGCCTCAAACC | 78 | 2108 |
| 455825 | 67843 | 67862 | GAAACCCTTTCTTCAGACCA | 79 | 2109 |
| 455826 | 68621 | 68640 | TCAAAACAGCAAGTGCTGAA | 60 | 2110 |
| 455827 | 69053 | 69072 | AACCCTAAAGGATCACATTA | 43 | 2111 |
| 455828 | 69357 | 69376 | CAAAGAGCCGTGTGGCAGGG | 65 | 2112 |
| 455829 | 69395 | 69414 | GACCAGCCGTGGGACCCCAA | 84 | 2113 |
| 455830 | 69473 | 69492 | CCACAGGAAGGGCGATGGTA | 58 | 2114 |
| 455831 | 69498 | 69517 | GCAGGAAAGGACCTGGCCTC | 45 | 2115 |
| 455832 | 70567 | 70586 | TTAGGGAGCTGACACCCTAG | 56 | 2116 |
| 455833 | 70645 | 70664 | CAATTCAGTGCAGAATTCAA | 80 | 2117 |
| 455834 | 70675 | 70694 | TCTGAGTTTACTTTGGGCCA | 75 | 2118 |
| 455835 | 70725 | 70744 | CATGATGACCATGTGAAAGA | 82 | 2119 |
| 455836 | 70890 | 70909 | CTGAATGCTTACACCAAGAG | 83 | 2120 |
| 455837 | 70973 | 70992 | CCAATTTTCTATGAGCTTTG | 85 | 2121 |
| 455838 | 71013 | 71032 | CTTTTATGTATAAAATAAGA | 6 | 2122 |
| 455839 | 71573 | 71592 | CCAGGTACATCTTCAATAGC | 75 | 2123 |
| 455840 | 71610 | 71629 | GTACAATTGCTTCAACTAGA | 87 | 2124 |
| 455841 | 71698 | 71717 | ACATTTTTGGATGAGGGCAT | 81 | 2125 |
| 455842 | 71750 | 71769 | AAAGCCAAAGGTTATATCTC | 77 | 2126 |
| 455843 | 71765 | 71784 | AATGCTTGTGGTTCCAAAGC | 79 | 2127 |
| 455844 | 71929 | 71948 | TGTAAAGTTTAACAGCCTC | 70 | 2128 |
| 455845 | 71992 | 72011 | CATAACCTTTTCCCACCTGA | 79 | 2129 |

TABLE 53-continued

Inhibition of human STAT3 mRNA levels by chimeric antisense oligonucleotides having 5-10-5 MOE wings and deoxy gap targeted to SEQ ID NO: 2

| ISIS NO | Human Start Site | Human Stop Site | Sequence | % inhibition | SEQ ID NO |
|---|---|---|---|---|---|
| 455846 | 72036 | 72055 | CAGTTCTTTGCACAAAGCTG | 76 | 2130 |
| 455847 | 72127 | 72146 | CAAGATTGTCTGGAAAGCTC | 76 | 2131 |
| 455848 | 72202 | 72221 | TCGCATTCAGTAAGCAGAGC | 47 | 2132 |
| 455849 | 72229 | 72248 | AAACCAGTTTTCTTACTGAC | 17 | 2133 |
| 455850 | 72285 | 72304 | CGGTGTCACACAGATAAACT | 73 | 2134 |
| 455851 | 72367 | 72386 | TTAACTCTCACCCAGTGTCC | 61 | 2135 |
| 455852 | 72406 | 72425 | GTACTAAACATAGCCCAGGG | 78 | 2136 |
| 455853 | 72687 | 72706 | AAATACTCACCAAACTGCCC | 4 | 2137 |
| 455854 | 72768 | 72787 | GTGACCAGCTCTCGGTGTGT | 10 | 2138 |
| 455855 | 73340 | 73359 | GATTTGGTTTGTCCAAACTG | 49 | 2139 |
| 455856 | 73530 | 73549 | GTCAGAAAAGCCAGATTTAC | 46 | 2140 |
| 455857 | 73621 | 73640 | GCAACTGGCAGGCCACGCCC | 39 | 2141 |
| 455858 | 73636 | 73655 | AGTTGTCCACCCTCTGCAAC | 0 | 2142 |
| 455859 | 73683 | 73702 | TGTCAAAGGTGAGGGACTCT | 57 | 2143 |
| 455860 | 74018 | 74037 | ACACAAGACATTTCCTTTTT | 64 | 1544 |

Example 33

Dose-Dependent Antisense Inhibition of Human STAT3 in HuVEC Cells

Gapmers from the study described in Example 32 exhibiting significant in vitro inhibition of STAT3 were tested at various doses in HuVEC cells. Cells were plated at a density of 5,000 cells per well and transfected using LipofectAMINE2000® reagent with 1.1 nM, 3.3 nM, 10.0 nM, and 30.0 nM concentrations of antisense oligonucleotide, as specified in Table 54. After a treatment period of approximately 16 hours, RNA was isolated from the cells and STAT3 mRNA levels were measured by quantitative real-time PCR. Human STAT3 primer probe set RTS199 (forward sequence ACATGCCACTTTGGTGTTTCATAA, designated herein as SEQ ID NO: 6; reverse sequence TCTTCGTAGATTGTGCTGATAGAGAAC, designated herein as SEQ ID NO: 7; probe sequence CAGTATAGCCGCTTCCTGCAAGAGTCGAA, designated herein as SEQ ID NO: 8) was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 54 and was calculated by plotting the concentrations of oligonucleotides used versus the percent inhibition of STAT3 mRNA expression achieved at each concentration, and noting the concentration of oligonucleotide at which 50% inhibition of STAT3 mRNA expression was achieved compared to the control. As illustrated in Table 54, STAT3 mRNA levels were significantly reduced in a dose-dependent manner in antisense oligonucleotide treated cells.

TABLE 54

Dose-dependent antisense inhibition of human STAT3 in HuVEC cells

| ISIS No | 1.1 nM | 3.3 nM | 10.0 nM | 30.0 nM | $IC_{50}$ (nM) |
|---|---|---|---|---|---|
| 337332 | 7 | 19 | 46 | 80 | 10.4 |
| 345785 | 8 | 22 | 46 | 74 | 11.3 |
| 455265 | 20 | 43 | 64 | 85 | 5.0 |
| 455267 | 16 | 30 | 62 | 79 | 6.7 |
| 455269 | 23 | 49 | 72 | 84 | 4.0 |
| 455270 | 3 | 28 | 60 | 79 | 8.1 |
| 455271 | 16 | 40 | 71 | 86 | 4.9 |
| 455272 | 28 | 30 | 57 | 86 | 5.7 |
| 455282 | 18 | 28 | 55 | 80 | 7.4 |
| 455291 | 21 | 45 | 75 | 85 | 4.1 |
| 455370 | 6 | 23 | 53 | 78 | 9.0 |
| 455371 | 15 | 46 | 73 | 90 | 4.5 |
| 455391 | 10 | 30 | 54 | 75 | 8.5 |
| 455393 | 6 | 33 | 62 | 81 | 7.0 |
| 455394 | 5 | 33 | 63 | 85 | 6.7 |
| 455398 | 7 | 25 | 56 | 76 | 8.8 |
| 455411 | 10 | 21 | 58 | 82 | 7.9 |
| 455412 | 15 | 27 | 50 | 79 | 8.4 |
| 455429 | 17 | 43 | 67 | 81 | 5.2 |
| 455438 | 20 | 43 | 66 | 83 | 5.0 |
| 455439 | 10 | 41 | 67 | 84 | 5.7 |
| 455447 | 7 | 23 | 53 | 87 | 7.7 |
| 455457 | 9 | 24 | 52 | 79 | 8.8 |
| 455458 | 8 | 34 | 62 | 83 | 6.7 |
| 455463 | 6 | 37 | 63 | 85 | 6.3 |
| 455471 | 11 | 42 | 67 | 78 | 5.9 |
| 455525 | 0 | 9 | 42 | 72 | 13.4 |
| 455527 | 0 | 21 | 60 | 87 | 7.8 |
| 455530 | 11 | 26 | 62 | 83 | 7.1 |
| 455536 | 5 | 21 | 62 | 85 | 7.6 |
| 455540 | 8 | 28 | 65 | 87 | 6.5 |
| 455547 | 6 | 19 | 45 | 67 | 13.4 |

TABLE 54-continued

Dose-dependent antisense inhibition of human STAT3 in HuVEC cells

| ISIS No | 1.1 nM | 3.3 nM | 10.0 nM | 30.0 nM | IC$_{50}$ (nM) |
|---|---|---|---|---|---|
| 455548 | 0 | 41 | 68 | 90 | 5.8 |
| 455551 | 0 | 3 | 33 | 72 | 15.9 |
| 455553 | 0 | 29 | 64 | 87 | 7.2 |
| 455565 | 0 | 19 | 54 | 86 | 8.8 |
| 455566 | 13 | 28 | 45 | 76 | 9.6 |
| 455569 | 0 | 16 | 47 | 76 | 11.1 |
| 455581 | 0 | 19 | 62 | 85 | 8.6 |
| 455582 | 0 | 26 | 70 | 89 | 6.9 |
| 455591 | 7 | 17 | 47 | 68 | 12.8 |
| 455594 | 0 | 16 | 48 | 76 | 10.9 |
| 455611 | 14 | 43 | 68 | 81 | 5.4 |
| 455637 | 10 | 22 | 56 | 76 | 8.9 |
| 455677 | 0 | 18 | 46 | 72 | 11.9 |
| 455681 | 16 | 19 | 42 | 69 | 13.0 |
| 455703 | 9 | 40 | 72 | 92 | 5.1 |
| 455708 | 11 | 15 | 45 | 77 | 10.7 |
| 455723 | 3 | 9 | 33 | 68 | 17.0 |
| 455762 | 0 | 9 | 42 | 70 | 14.1 |
| 455786 | 21 | 32 | 50 | 79 | 7.4 |
| 455790 | 13 | 19 | 56 | 84 | 7.8 |
| 455840 | 17 | 30 | 52 | 77 | 7.9 |

Example 34

Antisense Inhibition of Human STAT3 in HuVEC Cells by Oligonucleotides Designed by Microwalk Additional gapmers were designed based on the gapmers presented in Example 1 that demonstrated an inhibition of at least 50%. These gapmers were designed by creating gapmers shifted slightly upstream and downstream (i.e., "microwalk") of the original gapmers. These gapmers were tested in vitro. ISIS 337332 was also included in the assay as a comparator. Cultured HuVEC cells at a density of 5,000 cells per well were transfected using LipofectAMINE 2000® reagent with 30 nM antisense oligonucleotide. After a treatment period of approximately 24 hours, RNA was isolated from the cells and STAT3 mRNA levels were measured by quantitative real-time PCR. The human primer probe set RTS199, described hereinabove, was used to measure STAT3 mRNA levels. STAT3 mRNA levels were adjusted according to total RNA content, as measured by RIBOGREEN®. Results are presented as percent inhibition of STAT3, relative to untreated control cells. The results are presented in Table 55.

The chimeric antisense oligonucleotides in Table 55 were designed as 5-10-5 MOE gapmers. The gapmers designated with an asterisk (*) in Table 55 are the original gapmers from which gapmers, ISIS 465226-466744, were designed via microwalk. The 5-10-5 gapmers are 20 nucleosides in length, wherein the central gap segment is comprised of ten 2'-deoxy-nucleosides and is flanked on both sides (in the 5' and 3' directions) by wings comprising five nucleosides each. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5'-methylcytosines. "Target start site" indicates the 5'-most nucleoside to which the gapmer is targeted. "Target stop site" indicates the 3'-most nucleoside to which the gapmer is targeted. Each gapmer listed in Table 55 is targeted to the target region spanning nucleobases 2313-76017 of SEQ ID NO: 2 (the complement of GENBANK Accession No. NT_010755.14 truncated from nucleotides 4185000 to 4264000).

TABLE 55

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 466646 | 2313 | 2332 | CACACTATACACATTTTAA | 3 | 2144 |
| 466647 | 2314 | 2333 | ACACACTATACACATTTTA | 11 | 2145 |
| 466648 | 2315 | 2334 | TACACACTATACACATTTT | 8 | 2146 |
| 455525* | 2316 | 2335 | GTACACACTATACACATTT | 47 | 1824 |
| 466649 | 2317 | 2336 | GGTACACACTATACACATT | 46 | 2147 |
| 466650 | 2318 | 2337 | AGGTACACACTATACACAT | 46 | 2148 |
| 466651 | 2319 | 2338 | CAGGTACACACTATACACA | 54 | 2149 |
| 466652 | 2320 | 2339 | GCAGGTACACACTATACAC | 68 | 2150 |
| 466653 | 2321 | 2340 | AGCAGGTACACACTATACA | 43 | 2151 |
| 466654 | 2322 | 2341 | CAGCAGGTACACACTATAC | 56 | 2152 |
| 466655 | 2323 | 2342 | CCAGCAGGTACACACTATA | 72 | 2153 |
| 466656 | 2324 | 2343 | ACCAGCAGGTACACACTAT | 52 | 2154 |
| 466657 | 2325 | 2344 | GACCAGCAGGTACACACTA | 69 | 2155 |
| 466658 | 2326 | 2345 | AGACCAGCAGGTACACACT | 15 | 2156 |
| 466659 | 2327 | 2346 | AAGACCAGCAGGTACACAC | 49 | 2157 |
| 466660 | 2328 | 2347 | TAAGACCAGCAGGTACACAC | 59 | 2158 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 466661 | 2329 | 2348 | GTAAGACCAGCAGGTACACA | 73 | 2159 |
| 466662 | 2330 | 2349 | AGTAAGACCAGCAGGTACAC | 65 | 2160 |
| 466663 | 2331 | 2350 | CAGTAAGACCAGCAGGTACA | 64 | 2161 |
| 466664 | 2332 | 2351 | ACAGTAAGACCAGCAGGTAC | 53 | 2162 |
| 466665 | 2333 | 2352 | TACAGTAAGACCAGCAGGTA | 67 | 2163 |
| 466666 | 2334 | 2353 | ATACAGTAAGACCAGCAGGT | 75 | 2164 |
| 466667 | 2335 | 2354 | CATACAGTAAGACCAGCAGG | 66 | 2165 |
| 466668 | 2336 | 2355 | ACATACAGTAAGACCAGCAG | 55 | 2166 |
| 466669 | 2337 | 2356 | CACATACAGTAAGACCAGCA | 71 | 2167 |
| 466670 | 2338 | 2357 | GCACATACAGTAAGACCAGC | 83 | 2168 |
| 466671 | 2339 | 2358 | TGCACATACAGTAAGACCAG | 28 | 2169 |
| 466672 | 2340 | 2359 | TTGCACATACAGTAAGACCA | 70 | 2170 |
| 466673 | 2341 | 2360 | GTTGCACATACAGTAAGACC | 39 | 2171 |
| 466674 | 2342 | 2361 | AGTTGCACATACAGTAAGAC | 53 | 2172 |
| 466675 | 2343 | 2362 | TAGTTGCACATACAGTAAGA | 43 | 2173 |
| 455527* | 2383 | 2402 | GCCAAAAATTTACAACCCAT | 48 | 1826 |
| 465806 | 2384 | 2403 | AGCCAAAAATTTACAACCCA | 29 | 2174 |
| 465807 | 2385 | 2404 | CAGCCAAAAATTTACAACCC | 7 | 2175 |
| 465808 | 2386 | 2405 | CCAGCCAAAAATTTACAACC | 35 | 2176 |
| 465809 | 2387 | 2406 | GCCAGCCAAAAATTTACAAC | 10 | 2177 |
| 465810 | 2388 | 2407 | AGCCAGCCAAAAATTTACAA | 37 | 2178 |
| 465811 | 2389 | 2408 | CAGCCAGCCAAAAATTTACA | 29 | 2179 |
| 465812 | 2390 | 2409 | ACAGCCAGCCAAAAATTTAC | 3 | 2180 |
| 465813 | 2391 | 2410 | CACAGCCAGCCAAAAATTTA | 6 | 2181 |
| 465814 | 2392 | 2411 | GCACAGCCAGCCAAAAATTT | 35 | 2182 |
| 465815 | 2393 | 2412 | AGCACAGCCAGCCAAAAATT | 22 | 2183 |
| 465816 | 2394 | 2413 | CAGCACAGCCAGCCAAAAAT | 23 | 2184 |
| 465817 | 2395 | 2414 | TCAGCACAGCCAGCCAAAAA | 33 | 2185 |
| 465818 | 2396 | 2415 | ATCAGCACAGCCAGCCAAAA | 32 | 2186 |
| 465819 | 2397 | 2416 | TATCAGCACAGCCAGCCAAA | 48 | 2187 |
| 465820 | 2398 | 2417 | TTATCAGCACAGCCAGCCAA | 32 | 2188 |
| 465821 | 2399 | 2418 | TTTATCAGCACAGCCAGCCA | 0 | 2189 |
| 465822 | 2400 | 2419 | CTTTATCAGCACAGCCAGCC | 49 | 2190 |
| 465823 | 2401 | 2420 | GCTTTATCAGCACAGCCAGC | 69 | 2191 |
| 465824 | 2402 | 2421 | TGCTTTATCAGCACAGCCAG | 48 | 2192 |
| 465825 | 2403 | 2422 | ATGCTTTATCAGCACAGCCA | 74 | 2193 |
| 465826 | 2404 | 2423 | AATGCTTTATCAGCACAGCC | 62 | 2194 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465827 | 2405 | 2424 | CAATGCTTTATCAGCACAGC | 67 | 2195 |
| 465828 | 2406 | 2425 | CCAATGCTTTATCAGCACAG | 71 | 2196 |
| 465829 | 2407 | 2426 | CCCAATGCTTTATCAGCACA | 47 | 2197 |
| 465830 | 2408 | 2427 | GCCCAATGCTTTATCAGCAC | 81 | 2198 |
| 465831 | 2409 | 2428 | AGCCCAATGCTTTATCAGCA | 75 | 2199 |
| 465832 | 2410 | 2429 | AAGCCCAATGCTTTATCAGC | 57 | 2200 |
| 465349 | 2655 | 2674 | AGGCTCCAACCTCTAAAACA | 41 | 2201 |
| 465350 | 2656 | 2675 | AAGGCTCCAACCTCTAAAAC | 34 | 2202 |
| 465351 | 2657 | 2676 | CAAGGCTCCAACCTCTAAAA | 43 | 2203 |
| 465352 | 2658 | 2677 | TCAAGGCTCCAACCTCTAAA | 51 | 2204 |
| 465353 | 2659 | 2678 | ATCAAGGCTCCAACCTCTAA | 38 | 2205 |
| 465354 | 2660 | 2679 | AATCAAGGCTCCAACCTCTA | 29 | 2206 |
| 465355 | 2661 | 2680 | AAATCAAGGCTCCAACCTCT | 56 | 2207 |
| 465356 | 2662 | 2681 | AAAATCAAGGCTCCAACCTC | 24 | 2208 |
| 465357 | 2663 | 2682 | TAAAATCAAGGCTCCAACCT | 46 | 2209 |
| 465358 | 2664 | 2683 | CTAAAATCAAGGCTCCAACC | 45 | 2210 |
| 465359 | 2665 | 2684 | ACTAAAATCAAGGCTCCAAC | 50 | 2211 |
| 465366 | 2666 | 2685 | GACTAAAATCAAGGCTCCAA | 51 | 2212 |
| 465367 | 2667 | 2686 | AGACTAAAATCAAGGCTCCA | 64 | 2213 |
| 465368 | 2668 | 2687 | GAGACTAAAATCAAGGCTCC | 76 | 2214 |
| 455530* | 2669 | 2688 | AGAGACTAAAATCAAGGCTC | 74 | 1829 |
| 455536* | 5000 | 5019 | AGAACTGAAATTCCTTGGTC | 52 | 1835 |
| 465833 | 5001 | 5020 | CAGAACTGAAATTCCTTGGT | 81 | 2215 |
| 465834 | 5002 | 5021 | ACAGAACTGAAATTCCTTGG | 81 | 2216 |
| 465835 | 5003 | 5022 | AACAGAACTGAAATTCCTTG | 48 | 2217 |
| 465836 | 5004 | 5023 | GAACAGAACTGAAATTCCTT | 46 | 2218 |
| 465837 | 5005 | 5024 | AGAACAGAACTGAAATTCCT | 39 | 2219 |
| 465838 | 5006 | 5025 | AAGAACAGAACTGAAATTCC | 22 | 2220 |
| 465839 | 5007 | 5026 | AAAGAACAGAACTGAAATTC | 3 | 2221 |
| 465840 | 5008 | 5027 | AAAAGAACAGAACTGAAATT | 0 | 2222 |
| 465841 | 5009 | 5028 | CAAAAGAACAGAACTGAAAT | 0 | 2223 |
| 465842 | 5010 | 5029 | ACAAAAGAACAGAACTGAAA | 0 | 2224 |
| 465843 | 5011 | 5030 | TACAAAAGAACAGAACTGAA | 3 | 2225 |
| 465844 | 5012 | 5031 | CTACAAAAGAACAGAACTGA | 0 | 2226 |
| 465845 | 5013 | 5032 | CCTACAAAAGAACAGAACTG | 13 | 2227 |
| 465846 | 5014 | 5033 | CCCTACAAAAGAACAGAACT | 0 | 2228 |
| 465847 | 5015 | 5034 | CCCCTACAAAAGAACAGAAC | 7 | 2229 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465848 | 5016 | 5035 | TCCCCTACAAAAGAACAGAA | 33 | 2230 |
| 465849 | 5017 | 5036 | TTCCCCTACAAAAGAACAGA | 18 | 2231 |
| 465850 | 5018 | 5037 | CTTCCCCTACAAAAGAACAG | 0 | 2232 |
| 465851 | 5019 | 5038 | GCTTCCCCTACAAAAGAACA | 43 | 2233 |
| 465852 | 5020 | 5039 | AGCTTCCCCTACAAAAGAAC | 32 | 2234 |
| 465853 | 5021 | 5040 | AAGCTTCCCCTACAAAAGAA | 0 | 2235 |
| 465854 | 5022 | 5041 | AAAGCTTCCCCTACAAAAGA | 15 | 2236 |
| 465855 | 5023 | 5042 | AAAAGCTTCCCCTACAAAAG | 14 | 2237 |
| 465856 | 5024 | 5043 | TAAAAGCTTCCCCTACAAAA | 4 | 2238 |
| 465857 | 5025 | 5044 | TTAAAAGCTTCCCCTACAAA | 0 | 2239 |
| 465858 | 5026 | 5045 | TTTAAAAGCTTCCCCTACAA | 11 | 2240 |
| 465859 | 5027 | 5046 | TTTTAAAAGCTTCCCCTACA | 11 | 2241 |
| 465860 | 5688 | 5707 | CAGTGGTTTTATAAATGAC | 29 | 2242 |
| 465861 | 5689 | 5708 | TCAGTGGTTTTATAAATGA | 19 | 2243 |
| 465862 | 5690 | 5709 | TTCAGTGGTTTTATAAATG | 4 | 2244 |
| 465863 | 5691 | 5710 | TTTCAGTGGTTTTATAAAT | 0 | 2245 |
| 465864 | 5692 | 5711 | CTTTCAGTGGTTTTATAAA | 0 | 2246 |
| 465865 | 5693 | 5712 | TCTTTCAGTGGTTTTATAA | 0 | 2247 |
| 465866 | 5694 | 5713 | CTCTTTCAGTGGTTTTATA | 35 | 2248 |
| 465867 | 5695 | 5714 | ACTCTTTCAGTGGTTTTAT | 67 | 2249 |
| 465868 | 5696 | 5715 | TACTCTTTCAGTGGTTTTA | 60 | 2250 |
| 465886 | 5697 | 5716 | GTACTCTTTCAGTGGTTTTT | 85 | 2251 |
| 465887 | 5698 | 5717 | AGTACTCTTTCAGTGGTTTT | 62 | 2252 |
| 455540* | 5699 | 5718 | AAGTACTCTTTCAGTGGTTT | 76 | 1839 |
| 465888 | 5700 | 5719 | CAAGTACTCTTTCAGTGGTT | 80 | 2253 |
| 465906 | 5701 | 5720 | TCAAGTACTCTTTCAGTGGT | 74 | 2254 |
| 465926 | 5702 | 5721 | CTCAAGTACTCTTTCAGTGG | 80 | 2255 |
| 465927 | 5703 | 5722 | CCTCAAGTACTCTTTCAGTG | 71 | 2256 |
| 465928 | 5704 | 5723 | CCCTCAAGTACTCTTTCAGT | 54 | 2257 |
| 465929 | 5705 | 5724 | TCCCTCAAGTACTCTTTCAG | 33 | 2258 |
| 465930 | 5706 | 5725 | GTCCCTCAAGTACTCTTTCA | 56 | 2259 |
| 465931 | 5707 | 5726 | TGTCCCTCAAGTACTCTTTC | 43 | 2260 |
| 465932 | 5708 | 5727 | ATGTCCCTCAAGTACTCTTT | 33 | 2261 |
| 465486 | 7674 | 7693 | AAAGGGCTGCAAAAAATCTG | 39 | 2262 |
| 465487 | 7675 | 7694 | GAAAGGGCTGCAAAAAATCT | 11 | 2263 |
| 465488 | 7676 | 7695 | AGAAAGGGCTGCAAAAAATC | 28 | 2264 |
| 465489 | 7677 | 7696 | CAGAAAGGGCTGCAAAAAAT | 39 | 2265 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465490 | 7678 | 7697 | ACAGAAAGGGCTGCAAAAA | 29 | 2266 |
| 465506 | 7679 | 7698 | AACAGAAAGGGCTGCAAAA | 36 | 2267 |
| 465507 | 7680 | 7699 | AAACAGAAAGGGCTGCAAA | 35 | 2268 |
| 465508 | 7681 | 7700 | TAAACAGAAAGGGCTGCAA | 47 | 2269 |
| 455547* | 7682 | 7701 | GTAAACAGAAAGGGCTGCAA | 72 | 1846 |
| 465509 | 7683 | 7702 | GGTAAACAGAAAGGGCTGCA | 70 | 2270 |
| 465510 | 7684 | 7703 | TGGTAAACAGAAAGGGCTGC | 63 | 2271 |
| 465511 | 7685 | 7704 | CTGGTAAACAGAAAGGGCTG | 60 | 2272 |
| 465526 | 7686 | 7705 | CCTGGTAAACAGAAAGGGCT | 65 | 2273 |
| 465527 | 7687 | 7706 | ACCTGGTAAACAGAAAGGGC | 26 | 2274 |
| 465528 | 7688 | 7707 | AACCTGGTAAACAGAAAGGG | 53 | 2275 |
| 465529 | 7689 | 7708 | TAACCTGGTAAACAGAAAGG | 35 | 2276 |
| 465530 | 7690 | 7709 | ATAACCTGGTAAACAGAAAG | 3 | 2277 |
| 465531 | 7691 | 7710 | GATAACCTGGTAAACAGAAA | 17 | 2278 |
| 465532 | 7692 | 7711 | AGATAACCTGGTAAACAGAA | 14 | 2279 |
| 465533 | 7693 | 7712 | AAGATAACCTGGTAAACAGA | 26 | 2280 |
| 455548* | 8078 | 8097 | GGGCAGATTTACCTTCCTTA | 77 | 1847 |
| 466722 | 8241 | 8260 | AATAGCAATCACCTTAGGAA | 53 | 2281 |
| 466723 | 8242 | 8261 | CAATAGCAATCACCTTAGGA | 62 | 2282 |
| 466724 | 8243 | 8262 | ACAATAGCAATCACCTTAGG | 48 | 2283 |
| 455551* | 8244 | 8263 | TACAATAGCAATCACCTTAG | 65 | 1850 |
| 466725 | 8245 | 8264 | CTACAATAGCAATCACCTTA | 15 | 2284 |
| 466726 | 8246 | 8265 | ACTACAATAGCAATCACCTT | 45 | 2285 |
| 466727 | 8247 | 8266 | AACTACAATAGCAATCACCT | 42 | 2286 |
| 466728 | 8248 | 8267 | AAACTACAATAGCAATCACC | 26 | 2287 |
| 466729 | 8249 | 8268 | AAAACTACAATAGCAATCAC | 14 | 2288 |
| 466730 | 8250 | 8269 | CAAAACTACAATAGCAATCA | 0 | 2289 |
| 466731 | 8251 | 8270 | TCAAAACTACAATAGCAATC | 29 | 2290 |
| 466732 | 8252 | 8271 | TTCAAAACTACAATAGCAAT | 20 | 2291 |
| 466733 | 8253 | 8272 | TTTCAAAACTACAATAGCAA | 14 | 2292 |
| 466734 | 8254 | 8273 | GTTTCAAAACTACAATAGCA | 58 | 2293 |
| 466735 | 8255 | 8274 | TGTTTCAAAACTACAATAGC | 28 | 2294 |
| 466736 | 8256 | 8275 | GTGTTTCAAAACTACAATAG | 42 | 2295 |
| 466737 | 8257 | 8276 | AGTGTTTCAAAACTACAATA | 13 | 2296 |
| 466738 | 8258 | 8277 | AAGTGTTTCAAAACTACAAT | 18 | 2297 |
| 466739 | 8259 | 8278 | CAAGTGTTTCAAAACTACAA | 30 | 2298 |
| 466740 | 8260 | 8279 | CCAAGTGTTTCAAAACTACA | 49 | 2299 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 466741 | 8261 | 8280 | ACCAAGTGTTTCAAAACTAC | 46 | 2300 |
| 466742 | 8262 | 8281 | AACCAAGTGTTTCAAAACTA | 41 | 2301 |
| 466743 | 8263 | 8282 | CAACCAAGTGTTTCAAAACT | 13 | 2302 |
| 455553* | 9123 11261 | 9142 11280 | ACCTGCCCCTATGTATAAGC | 75 | 1852 |
| 466744 | 9124 11262 | 9143 11281 | CACCTGCCCCTATGTATAAG | 67 | 2303 |
| 466745 | 9125 11263 | 9144 11282 | CCACCTGCCCCTATGTATAA | 69 | 2304 |
| 466746 | 9126 11264 | 9145 11283 | TCCACCTGCCCCTATGTATA | 68 | 2305 |
| 466747 | 9127 11265 | 9146 11284 | TTCCACCTGCCCCTATGTAT | 69 | 2306 |
| 466748 | 9128 11266 | 9147 11285 | ATTCCACCTGCCCCTATGTA | 58 | 2307 |
| 466749 | 9129 11267 | 9148 11286 | TATTCCACCTGCCCCTATGT | 38 | 2308 |
| 466750 | 9130 11268 | 9149 11287 | TTATTCCACCTGCCCCTATG | 47 | 309 |
| 466751 | 9131 | 9150 | TTTATTCCACCTGCCCCTAT | 54 | 2310 |
| 466752 | 9132 | 9151 | TTTTATTCCACCTGCCCCTA | 50 | 2311 |
| 466753 | 9133 | 9152 | GTTTTATTCCACCTGCCCCT | 58 | 2312 |
| 466754 | 9134 | 9153 | TGTTTTATTCCACCTGCCCC | 53 | 2313 |
| 466755 | 9135 | 9154 | ATGTTTTATTCCACCTGCCC | 69 | 2314 |
| 466756 | 9136 | 9155 | TATGTTTTATTCCACCTGCC | 3 | 2315 |
| 466757 | 9137 | 9156 | TTATGTTTTATTCCACCTGC | 48 | 2316 |
| 466758 | 9138 | 9157 | ATTATGTTTTATTCCACCTG | 53 | 2317 |
| 466759 | 9139 | 9158 | AATTATGTTTTATTCCACCT | 24 | 2318 |
| 466760 | 9140 | 9159 | TAATTATGTTTTATTCCACC | 10 | 2319 |
| 466761 | 9141 | 9160 | CTAATTATGTTTTATTCCAC | 13 | 2320 |
| 466762 | 9142 | 9161 | CCTAATTATGTTTTATTCCA | 23 | 2321 |
| 466763 | 9143 | 9162 | TCCTAATTATGTTTTATTCC | 27 | 2322 |
| 466764 | 9144 | 9163 | CTCCTAATTATGTTTTATTC | 21 | 2323 |
| 466765 | 9145 | 9164 | CCTCCTAATTATGTTTTATT | 30 | 2324 |
| 465740 | 9862 12345 | 9881 12364 | TGGCTTCTTCCTGAGACACA | 81 | 2325 |
| 465741 | 9863 12346 | 9882 12365 | TTGGCTTCTTCCTGAGACAC | 68 | 2326 |
| 465742 | 9864 12347 | 9883 12366 | GTTGGCTTCTTCCTGAGACA | 81 | 2327 |
| 465743 | 9865 12348 | 9884 12367 | TGTTGGCTTCTTCCTGAGAC | 68 | 2328 |
| 465744 | 9866 | 9885 | CTGTTGGCTTCTTCCTGAGA | 44 | 2329 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| | 12349 | 12368 | | | |
| 465745 | 9867 | 9886 | CCTGTTGGCTTCTTCCTGAG | 73 | 2330 |
| | 12350 | 12369 | | | |
| 465746 | 9868 | 9887 | TCCTGTTGGCTTCTTCCTGA | 61 | 2331 |
| | 12351 | 12370 | | | |
| 465747 | 9869 | 9888 | CTCCTGTTGGCTTCTTCCTG | 53 | 2332 |
| | 12352 | 12371 | | | |
| 465748 | 9870 | 9889 | CCTCCTGTTGGCTTCTTCCT | 78 | 2333 |
| | 12353 | 12372 | | | |
| 465749 | 9871 | 9890 | TCCTCCTGTTGGCTTCTTCC | 73 | 2334 |
| | 12354 | 12373 | | | |
| 465750 | 9872 | 9891 | TTCCTCCTGTTGGCTTCTTC | 70 | 2335 |
| | 12355 | 12374 | | | |
| 465751 | 9873 | 9892 | GTTCCTCCTGTTGGCTTCTT | 89 | 2336 |
| | 12356 | 12375 | | | |
| 465752 | 9874 | 9893 | GGTTCCTCCTGTTGGCTTCT | 86 | 2337 |
| | 12357 | 12376 | | | |
| 465753 | 9875 | 9894 | AGGTTCCTCCTGTTGGCTTC | 73 | 2338 |
| | 12358 | 12377 | | | |
| 465754 | 9876 | 9895 | AAGGTTCCTCCTGTTGGCTT | 85 | 2339 |
| | 12359 | 12378 | | | |
| 465755 | 9877 | 9896 | TAAGGTTCCTCCTGTTGGCT | 82 | 2340 |
| | 12360 | 12379 | | | |
| 465756 | 9878 | 9897 | ATAAGGTTCCTCCTGTTGGC | 72 | 2341 |
| | 12361 | 12380 | | | |
| 465757 | 9879 | 9898 | AATAAGGTTCCTCCTGTTGG | 61 | 2342 |
| | 12362 | 12381 | | | |
| 465758 | 9880 | 9899 | AAATAAGGTTCCTCCTGTTG | 40 | 2343 |
| | 12363 | 12382 | | | |
| 465759 | 9881 | 9900 | AAAATAAGGTTCCTCCTGTT | 41 | 2344 |
| | 12364 | 12383 | | | |
| 465760 | 9882 | 9901 | CAAAATAAGGTTCCTCCTGT | 20 | 2345 |
| | 12365 | 12384 | | | |
| 465761 | 9883 | 9902 | TCAAAATAAGGTTCCTCCTG | 57 | 2346 |
| | 12366 | 12385 | | | |
| 465762 | 9884 | 9903 | CTCAAAATAAGGTTCCTCCT | 48 | 2347 |
| | 12367 | 12386 | | | |
| 465763 | 9885 | 9904 | ACTCAAAATAAGGTTCCTCC | 52 | 2348 |
| | 12368 | 12387 | | | |
| 455566* | 9886 | 9905 | GACTCAAAATAAGGTTCCTC | 59 | 1855 |
| | 12369 | 12388 | | | |
| 465764 | 9887 | 9906 | TGACTCAAAATAAGGTTCCT | 54 | 2349 |
| | 12370 | 12389 | | | |
| 465765 | 9888 | 9907 | CTGACTCAAAATAAGGTTCC | 47 | 2350 |
| | 12371 | 12390 | | | |
| 465766 | 9889 | 9908 | CCTGACTCAAAATAAGGTTC | 55 | 2351 |
| | 12372 | 12391 | | | |
| 465767 | 9890 | 9909 | ACCTGACTCAAAATAAGGTT | 48 | 2352 |
| | 12373 | 12382 | | | |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 455553* | 9123 11261 | 9142 11280 | ACCTGCCCCTATGTATAAGC | 75 | 1852 |
| 466744 | 9124 11262 | 9143 11281 | CACCTGCCCCTATGTATAAG | 67 | 2303 |
| 466745 | 9125 11263 | 9144 11282 | CCACCTGCCCCTATGTATAA | 69 | 2304 |
| 466746 | 9126 11264 | 9145 11283 | TCCACCTGCCCCTATGTATA | 68 | 2305 |
| 466747 | 9127 11265 | 9146 11284 | TTCCACCTGCCCCTATGTAT | 69 | 2306 |
| 466748 | 9128 11266 | 9147 11285 | ATTCCACCTGCCCCTATGTA | 58 | 2307 |
| 466749 | 9129 11267 | 9148 11286 | TATTCCACCTGCCCCTATGT | 38 | 2308 |
| 466750 | 9130 11268 | 9149 11287 | TTATTCCACCTGCCCCTATG | 47 | 2309 |
| 465726 | 11695 | 11714 | TTAATCTTTCCTAGGCAAAG | 19 | 2353 |
| 465727 | 11696 | 11715 | ATTAATCTTTCCTAGGCAAA | 22 | 2354 |
| 465728 | 11697 | 11716 | CATTAATCTTTCCTAGGCAA | 43 | 2355 |
| 465729 | 11698 | 11717 | GCATTAATCTTTCCTAGGCA | 68 | 2356 |
| 465730 | 11699 | 11718 | AGCATTAATCTTTCCTAGGC | 80 | 2357 |
| 455565* | 11700 | 11719 | TAGCATTAATCTTTCCTAGG | 74 | 1864 |
| 465731 | 11701 | 11720 | TTAGCATTAATCTTTCCTAG | 42 | 2358 |
| 465732 | 11702 | 11721 | ATTAGCATTAATCTTTCCTA | 22 | 2359 |
| 465733 | 11703 | 11722 | GATTAGCATTAATCTTTCCT | 40 | 2360 |
| 465734 | 11704 | 11723 | AGATTAGCATTAATCTTTCC | 0 | 2361 |
| 465735 | 11705 | 11724 | AAGATTAGCATTAATCTTTC | 10 | 2362 |
| 465736 | 11706 | 11725 | TAAGATTAGCATTAATCTTT | 3 | 2363 |
| 465737 | 12342 | 12361 | CTTCTTCCTGAGACACAGCC | 71 | 2364 |
| 465738 | 12343 | 12362 | GCTTCTTCCTGAGACACAGC | 74 | 2365 |
| 465739 | 12344 | 12363 | GGCTTCTTCCTGAGACACAG | 83 | 2366 |
| 465740 | 9862 12345 | 9881 12364 | TGGCTTCTTCCTGAGACACA | 81 | 2325 |
| 465741 | 9863 12346 | 9882 12365 | TTGGCTTCTTCCTGAGACAC | 68 | 2326 |
| 465742 | 9864 12347 | 9883 12366 | GTTGGCTTCTTCCTGAGACA | 81 | 2327 |
| 465743 | 9865 12348 | 9884 12367 | TGTTGGCTTCTTCCTGAGAC | 68 | 2328 |
| 465744 | 9866 12349 | 9885 12368 | CTGTTGGCTTCTTCCTGAGA | 44 | 2329 |
| 465745 | 9867 12350 | 9886 12369 | CCTGTTGGCTTCTTCCTGAG | 73 | 2330 |
| 465746 | 9868 12351 | 9887 12370 | TCCTGTTGGCTTCTTCCTGA | 61 | 2331 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465747 | 9869 12352 | 9888 12371 | CTCCTGTTGGCTTCTTCCTG | 53 | 2332 |
| 465748 | 9870 12353 | 9889 12372 | CCTCCTGTTGGCTTCTTCCT | 78 | 2333 |
| 465749 | 9871 12354 | 9890 12373 | TCCTCCTGTTGGCTTCTTCC | 73 | 2334 |
| 465750 | 9872 12355 | 9891 12374 | TTCCTCCTGTTGGCTTCTTC | 70 | 2335 |
| 465751 | 9873 12356 | 9892 12375 | GTTCCTCCTGTTGGCTTCTT | 89 | 2336 |
| 465752 | 9874 12357 | 9893 12376 | GGTTCCTCCTGTTGGCTTCT | 86 | 2337 |
| 465753 | 9875 12358 | 9894 12377 | AGGTTCCTCCTGTTGGCTTC | 73 | 2338 |
| 465754 | 9876 12359 | 9895 12378 | AAGGTTCCTCCTGTTGGCTT | 85 | 2339 |
| 465755 | 9877 12360 | 9896 12379 | TAAGGTTCCTCCTGTTGGCT | 82 | 2340 |
| 465756 | 9878 12361 | 9897 12380 | ATAAGGTTCCTCCTGTTGGC | 72 | 2341 |
| 465757 | 9879 12362 | 9898 12381 | AATAAGGTTCCTCCTGTTGG | 61 | 2342 |
| 465758 | 9880 12363 | 9899 12382 | AAATAAGGTTCCTCCTGTTG | 40 | 2343 |
| 465759 | 9881 12364 | 9900 12383 | AAAATAAGGTTCCTCCTGTT | 41 | 2344 |
| 465760 | 9882 12365 | 9901 12384 | CAAAATAAGGTTCCTCCTGT | 20 | 2345 |
| 465761 | 9883 12366 | 9902 12385 | TCAAAATAAGGTTCCTCCTG | 57 | 2346 |
| 465762 | 9884 12367 | 9903 12386 | CTCAAAATAAGGTTCCTCCT | 48 | 2347 |
| 465763 | 9885 12368 | 9904 12387 | ACTCAAAATAAGGTTCCTCC | 52 | 2348 |
| 455566* | 9886 12369 | 9905 12388 | GACTCAAAATAAGGTTCCTC | 59 | 1865 |
| 465764 | 9887 12370 | 9906 12389 | TGACTCAAAATAAGGTTCCT | 54 | 2349 |
| 465765 | 9888 12371 | 9907 12390 | CTGACTCAAAATAAGGTTCC | 47 | 2350 |
| 465766 | 9889 12372 | 9908 12391 | CCTGACTCAAAATAAGGTTC | 55 | 2351 |
| 465767 | 9890 12373 | 9909 12392 | ACCTGACTCAAAATAAGGTT | 48 | 2352 |
| 465369 | 14101 | 14120 | TGAGGATGACCCCAGATAAA | 64 | 2367 |
| 465370 | 14102 | 14121 | GTGAGGATGACCCCAGATAA | 60 | 2368 |
| 465371 | 14103 | 14122 | TGTGAGGATGACCCCAGATA | 47 | 2369 |
| 465372 | 14104 | 14123 | CTGTGAGGATGACCCCAGAT | 68 | 2370 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465373 | 14105 | 14124 | CCTGTGAGGATGACCCCAGA | 67 | 2371 |
| 465374 | 14106 | 14125 | GCCTGTGAGGATGACCCCAG | 70 | 2372 |
| 465375 | 14107 | 14126 | TGCCTGTGAGGATGACCCCA | 75 | 2373 |
| 465376 | 14108 | 14127 | ATGCCTGTGAGGATGACCCC | 72 | 2374 |
| 465377 | 14109 | 14128 | TATGCCTGTGAGGATGACCC | 58 | 2375 |
| 465378 | 14110 | 14129 | CTATGCCTGTGAGGATGACC | 56 | 2376 |
| 465379 | 14111 | 14130 | GCTATGCCTGTGAGGATGAC | 65 | 2377 |
| 465380 | 14112 | 14131 | TGCTATGCCTGTGAGGATGA | 23 | 2378 |
| 465386 | 14113 | 14132 | CTGCTATGCCTGTGAGGATG | 64 | 2379 |
| 465387 | 14114 | 14133 | TCTGCTATGCCTGTGAGGAT | 66 | 2380 |
| 465388 | 14115 | 14134 | ATCTGCTATGCCTGTGAGGA | 69 | 2381 |
| 465389 | 14116 | 14135 | TATCTGCTATGCCTGTGAGG | 59 | 2382 |
| 465390 | 14117 | 14136 | ATATCTGCTATGCCTGTGAG | 51 | 2383 |
| 465391 | 14118 | 14137 | AATATCTGCTATGCCTGTGA | 57 | 2384 |
| 465392 | 14119 | 14138 | GAATATCTGCTATGCCTGTG | 60 | 2385 |
| 465393 | 14120 | 14139 | AGAATATCTGCTATGCCTGT | 53 | 2386 |
| 465394 | 14121 | 14140 | CAGAATATCTGCTATGCCTG | 55 | 2387 |
| 465395 | 14122 | 14141 | TCAGAATATCTGCTATGCCT | 64 | 2388 |
| 465396 | 14123 | 14142 | ATCAGAATATCTGCTATGCC | 43 | 2389 |
| 465397 | 14124 | 14143 | AATCAGAATATCTGCTATGC | 37 | 2390 |
| 465398 | 14125 | 14144 | GAATCAGAATATCTGCTATG | 22 | 2391 |
| 465399 | 14126 | 14145 | TGAATCAGAATATCTGCTAT | 33 | 2392 |
| 465400 | 14127 | 14146 | CTGAATCAGAATATCTGCTA | 58 | 2393 |
| 465401 | 14128 | 14147 | TCTGAATCAGAATATCTGCT | 77 | 2394 |
| 455569* | 14129 | 14148 | ATCTGAATCAGAATATCTGC | 67 | 1868 |
| 465406 | 14130 | 14149 | CATCTGAATCAGAATATCTG | 45 | 2395 |
| 465407 | 14131 | 14150 | CCATCTGAATCAGAATATCT | 47 | 2396 |
| 465408 | 14132 | 14151 | ACCATCTGAATCAGAATATC | 55 | 2397 |
| 465409 | 14133 | 14152 | GACCATCTGAATCAGAATAT | 72 | 2398 |
| 465410 | 14134 | 14153 | GGACCATCTGAATCAGAATA | 70 | 2399 |
| 465411 | 14135 | 14154 | AGGACCATCTGAATCAGAAT | 67 | 2400 |
| 465426 | 14136 | 14155 | AAGGACCATCTGAATCAGAA | 71 | 2401 |
| 465427 | 14137 | 14156 | CAAGGACCATCTGAATCAGA | 73 | 2402 |
| 465428 | 14138 | 14157 | CCAAGGACCATCTGAATCAG | 64 | 2403 |
| 465429 | 14139 | 14158 | ACCAAGGACCATCTGAATCA | 54 | 2404 |
| 465446 | 14140 | 14159 | GACCAAGGACCATCTGAATC | 65 | 2405 |
| 465447 | 14141 | 14160 | GGACCAAGGACCATCTGAAT | 72 | 2406 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465448 | 14142 | 14161 | AGGACCAAGGACCATCTGAA | 68 | 2407 |
| 465449 | 14143 | 14162 | AAGGACCAAGGACCATCTGA | 78 | 2408 |
| 465450 | 14144 | 14163 | TAAGGACCAAGGACCATCTG | 37 | 2409 |
| 465451 | 14145 | 14164 | CTAAGGACCAAGGACCATCT | 73 | 2410 |
| 465452 | 14146 | 14165 | ACTAAGGACCAAGGACCATC | 65 | 2411 |
| 465453 | 14147 | 14166 | AACTAAGGACCAAGGACCAT | 54 | 2412 |
| 465454 | 14148 | 14167 | AAACTAAGGACCAAGGACCA | 49 | 2413 |
| 465455 | 14149 | 14168 | CAAACTAAGGACCAAGGACC | 61 | 2414 |
| 465456 | 14150 | 14169 | TCAAACTAAGGACCAAGGAC | 53 | 2415 |
| 465457 | 14151 | 14170 | CTCAAACTAAGGACCAAGGA | 59 | 2416 |
| 465534 | 16802 | 16821 | CAACAGAGTGAAATGTAATG | 16 | 2417 |
| 465535 | 16803 | 16822 | TCAACAGAGTGAAATGTAAT | 12 | 2418 |
| 465536 | 16804 | 16823 | CTCAACAGAGTGAAATGTAA | 52 | 2419 |
| 465537 | 16805 | 16824 | GCTCAACAGAGTGAAATGTA | 74 | 2420 |
| 465538 | 16806 | 16825 | TGCTCAACAGAGTGAAATGT | 17 | 2421 |
| 465539 | 16807 | 16826 | ATGCTCAACAGAGTGAAATG | 37 | 2422 |
| 465540 | 16808 | 16827 | AATGCTCAACAGAGTGAAAT | 14 | 2423 |
| 465541 | 16809 | 16828 | GAATGCTCAACAGAGTGAAA | 30 | 2424 |
| 465542 | 16810 | 16829 | AGAATGCTCAACAGAGTGAA | 23 | 2425 |
| 465543 | 16811 | 16830 | TAGAATGCTCAACAGAGTGA | 43 | 2426 |
| 465544 | 16812 | 16831 | ATAGAATGCTCAACAGAGTG | 38 | 2427 |
| 465545 | 16813 | 16832 | CATAGAATGCTCAACAGAGT | 38 | 2428 |
| 465546 | 16814 | 16833 | CCATAGAATGCTCAACAGAG | 56 | 2429 |
| 465547 | 16815 | 16834 | TCCATAGAATGCTCAACAGA | 37 | 2430 |
| 465548 | 16816 | 16835 | ATCCATAGAATGCTCAACAG | 48 | 2431 |
| 465549 | 16817 | 16836 | AATCCATAGAATGCTCAACA | 24 | 2432 |
| 465550 | 16818 | 16837 | AAATCCATAGAATGCTCAAC | 34 | 2433 |
| 465551 | 16819 | 16838 | AAAATCCATAGAATGCTCAA | 30 | 2434 |
| 465552 | 16820 | 16839 | CAAAATCCATAGAATGCTCA | 32 | 2435 |
| 465553 | 16821 | 16840 | TCAAAATCCATAGAATGCTC | 46 | 2436 |
| 465554 | 16822 | 16841 | GTCAAAATCCATAGAATGCT | 57 | 2437 |
| 465555 | 16823 | 16842 | TGTCAAAATCCATAGAATGC | 32 | 2438 |
| 465556 | 16824 | 16843 | TTGTCAAAATCCATAGAATG | 5 | 2439 |
| 465557 | 16825 | 16844 | TTTGTCAAAATCCATAGAAT | 2 | 2440 |
| 465558 | 16826 | 16845 | ATTTGTCAAAATCCATAGAA | 17 | 2441 |
| 465559 | 16827 | 16846 | CATTTGTCAAAATCCATAGA | 17 | 2442 |
| 465560 | 16828 | 16847 | ACATTTGTCAAAATCCATAG | 31 | 2443 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465561 | 16829 | 16848 | CACATTTGTCAAAATCCATA | 43 | 2444 |
| 465562 | 16830 | 16849 | ACACATTTGTCAAAATCCAT | 42 | 2445 |
| 465563 | 16831 | 16850 | CACACATTTGTCAAAATCCA | 56 | 2446 |
| 455581* | 16832 | 16851 | TCACACATTTGTCAAAATCC | 55 | 1880 |
| 465564 | 16833 | 16852 | ATCACACATTTGTCAAAATC | 34 | 2447 |
| 465565 | 16834 | 16853 | CATCACACATTTGTCAAAAT | 40 | 2448 |
| 465566 | 16835 | 16854 | TCATCACACATTTGTCAAAA | 41 | 2449 |
| 465567 | 16836 | 16855 | ATCATCACACATTTGTCAAA | 37 | 2450 |
| 465568 | 16837 | 16856 | CATCATCACACATTTGTCAA | 44 | 2451 |
| 465569 | 16838 | 16857 | ACATCATCACACATTTGTCA | 60 | 2452 |
| 465570 | 16839 | 16858 | TACATCATCACACATTTGTC | 9 | 2453 |
| 465571 | 16840 | 16859 | ATACATCATCACACATTTGT | 48 | 2454 |
| 465572 | 16841 | 16860 | TATACATCATCACACATTTG | 46 | 2455 |
| 465573 | 16842 | 16861 | ATATACATCATCACACATTT | 28 | 2456 |
| 455582* | 16863 | 16882 | TATATAATTGTGTACTGGCA | 79 | 1881 |
| 465458 | 16864 | 16883 | TTATATAATTGTGTACTGGC | 83 | 2457 |
| 465459 | 16865 | 16884 | TTTATATAATTGTGTACTGG | 22 | 2458 |
| 465460 | 16866 | 16885 | TTTTATATAATTGTGTACTG | 8 | 2459 |
| 465461 | 16867 | 16886 | ATTTTATATAATTGTGTACT | 0 | 2460 |
| 465462 | 16868 | 16887 | TATTTTATATAATTGTGTAC | 1 | 2461 |
| 465463 | 16869 | 16888 | CTATTTTATATAATTGTGTA | 9 | 2462 |
| 465464 | 16870 | 16889 | ACTATTTTATATAATTGTGT | 0 | 2463 |
| 465465 | 16871 | 16890 | AACTATTTTATATAATTGTG | 7 | 2464 |
| 465466 | 16872 | 16891 | AAACTATTTTATATAATTGT | 13 | 2465 |
| 465606 | 21187 | 21206 | TAATGAGACTTTAGCACTCT | 67 | 2466 |
| 455591* | 21188 | 21207 | ATAATGAGACTTTAGCACTC | 62 | 1890 |
| 465607 | 21189 | 21208 | AATAATGAGACTTTAGCACT | 41 | 2467 |
| 465608 | 21190 | 21209 | CAATAATGAGACTTTAGCAC | 54 | 2468 |
| 465609 | 21191 | 21210 | GCAATAATGAGACTTTAGCA | 6 | 2469 |
| 465610 | 21193 | 21212 | CTGCAATAATGAGACTTTAG | 77 | 2470 |
| 465611 | 21194 | 21213 | ACTGCAATAATGAGACTTTA | 53 | 2471 |
| 465612 | 21195 | 21214 | AACTGCAATAATGAGACTTT | 39 | 2472 |
| 465266 | 21638 | 21657 | ATTTGAATAAATGAATGAAA | 0 | 2473 |
| 465267 | 21639 | 21658 | TATTTGAATAAATGAATGAA | 0 | 2474 |
| 465268 | 21640 | 21659 | ATATTTGAATAAATGAATGA | 0 | 2475 |
| 465269 | 21641 | 21660 | AATATTTGAATAAATGAATG | 0 | 2476 |
| 465270 | 21642 | 21661 | AAATATTTGAATAAATGAAT | 0 | 2477 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465271 | 21643 | 21662 | CAAATATTTGAATAAATGAA | 0 | 2478 |
| 465272 | 21644 | 21663 | TCAAATATTTGAATAAATGA | 0 | 2479 |
| 465273 | 21645 | 21664 | CTCAAATATTTGAATAAATG | 0 | 2480 |
| 465274 | 21646 | 21665 | GCTCAAATATTTGAATAAAT | 0 | 2481 |
| 465275 | 21647 | 21666 | TGCTCAAATATTTGAATAAA | 6 | 2482 |
| 465276 | 21648 | 21667 | ATGCTCAAATATTTGAATAA | 0 | 2483 |
| 465277 | 21649 | 21668 | AATGCTCAAATATTTGAATA | 0 | 2484 |
| 465278 | 21650 | 21669 | GAATGCTCAAATATTTGAAT | 19 | 2485 |
| 465279 | 21651 | 21670 | AGAATGCTCAAATATTTGAA | 0 | 2486 |
| 465280 | 21652 | 21671 | CAGAATGCTCAAATATTTGA | 5 | 2487 |
| 465281 | 21653 | 21672 | ACAGAATGCTCAAATATTTG | 9 | 2488 |
| 465282 | 21654 | 21673 | TACAGAATGCTCAAATATTT | 1 | 2489 |
| 465283 | 21655 | 21674 | CTACAGAATGCTCAAATATT | 0 | 2490 |
| 465284 | 21656 | 21675 | ACTACAGAATGCTCAAATAT | 0 | 2491 |
| 465285 | 21657 | 21676 | AACTACAGAATGCTCAAATA | 2 | 2492 |
| 465286 | 21658 | 21677 | CAACTACAGAATGCTCAAAT | 12 | 2493 |
| 465287 | 21659 | 21678 | GCAACTACAGAATGCTCAAA | 26 | 2494 |
| 465288 | 21660 | 21679 | AGCAACTACAGAATGCTCAA | 39 | 2495 |
| 465289 | 21661 | 21680 | CAGCAACTACAGAATGCTCA | 53 | 2496 |
| 465290 | 21662 | 21681 | CCAGCAACTACAGAATGCTC | 26 | 2497 |
| 465291 | 21663 | 21682 | CCCAGCAACTACAGAATGCT | 42 | 2498 |
| 465292 | 21664 | 21683 | CCCCAGCAACTACAGAATGC | 40 | 2499 |
| 465293 | 21665 | 21684 | TCCCCAGCAACTACAGAATG | 13 | 2500 |
| 465294 | 21666 | 21685 | TTCCCCAGCAACTACAGAAT | 30 | 2501 |
| 465295 | 21667 | 21686 | TTTCCCCAGCAACTACAGAA | 16 | 2502 |
| 465296 | 21668 | 21687 | ATTTCCCCAGCAACTACAGA | 5 | 2503 |
| 465297 | 21669 | 21688 | TATTTCCCCAGCAACTACAG | 7 | 2504 |
| 465298 | 21670 | 21689 | CTATTTCCCCAGCAACTACA | 20 | 2505 |
| 465299 | 21671 | 21690 | GCTATTTCCCCAGCAACTAC | 7 | 2506 |
| 465300 | 21672 | 21691 | TGCTATTTCCCCAGCAACTA | 25 | 2507 |
| 465301 | 21673 | 21692 | CTGCTATTTCCCCAGCAACT | 31 | 2508 |
| 465302 | 21674 | 21693 | ACTGCTATTTCCCCAGCAAC | 14 | 2509 |
| 455594* | 21675 | 21694 | CACTGCTATTTCCCCAGCAA | 43 | 1893 |
| 465303 | 21676 | 21695 | TCACTGCTATTTCCCCAGCA | 23 | 2510 |
| 465304 | 21677 | 21696 | TTCACTGCTATTTCCCCAGC | 45 | 2511 |
| 465305 | 21678 | 21697 | GTTCACTGCTATTTCCCCAG | 11 | 2512 |
| 465306 | 21679 | 21698 | AGTTCACTGCTATTTCCCCA | 62 | 2513 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465307 | 21680 | 21699 | CAGTTCACTGCTATTTCCCC | 52 | 2514 |
| 465308 | 21681 | 21700 | TCAGTTCACTGCTATTTCCC | 40 | 2515 |
| 465309 | 21682 | 21701 | TTCAGTTCACTGCTATTTCC | 29 | 2516 |
| 465310 | 21683 | 21702 | CTTCAGTTCACTGCTATTTC | 40 | 2517 |
| 465311 | 21684 | 21703 | TCTTCAGTTCACTGCTATTT | 25 | 2518 |
| 465312 | 21685 | 21704 | TTCTTCAGTTCACTGCTATT | 18 | 2519 |
| 465313 | 21686 | 21705 | ATTCTTCAGTTCACTGCTAT | 7 | 2520 |
| 465314 | 21687 | 21706 | CATTCTTCAGTTCACTGCTA | 33 | 2521 |
| 465315 | 21688 | 21707 | ACATTCTTCAGTTCACTGCT | 39 | 2522 |
| 465316 | 21689 | 21708 | GACATTCTTCAGTTCACTGC | 49 | 2523 |
| 465317 | 21690 | 21709 | AGACATTCTTCAGTTCACTG | 50 | 2524 |
| 465318 | 21691 | 21710 | AAGACATTCTTCAGTTCACT | 37 | 2525 |
| 465319 | 21692 | 21711 | AAAGACATTCTTCAGTTCAC | 26 | 2526 |
| 465320 | 21693 | 21712 | CAAAGACATTCTTCAGTTCA | 13 | 2527 |
| 465321 | 21694 | 21713 | ACAAAGACATTCTTCAGTTC | 0 | 2528 |
| 465322 | 21695 | 21714 | AACAAAGACATTCTTCAGTT | 11 | 2529 |
| 465323 | 21696 | 21715 | GAACAAAGACATTCTTCAGT | 10 | 2530 |
| 465324 | 21697 | 21716 | AGAACAAAGACATTCTTCAG | 14 | 2531 |
| 465325 | 21698 | 21717 | AAGAACAAAGACATTCTTCA | 7 | 2532 |
| 465326 | 21699 | 21718 | TAAGAACAAAGACATTCTTC | 13 | 2533 |
| 465327 | 21700 | 21719 | ATAAGAACAAAGACATTCTT | 1 | 2534 |
| 465328 | 21701 | 21720 | CATAAGAACAAAGACATTCT | 16 | 2535 |
| 465329 | 21702 | 21721 | CCATAAGAACAAAGACATTC | 38 | 2536 |
| 465330 | 21703 | 21722 | CCCATAAGAACAAAGACATT | 11 | 2537 |
| 465331 | 21704 | 21723 | CCCCATAAGAACAAAGACAT | 0 | 2538 |
| 465332 | 21705 | 21724 | GCCCCATAAGAACAAAGACA | 30 | 2539 |
| 465333 | 21706 | 21725 | AGCCCCATAAGAACAAAGAC | 22 | 2540 |
| 465334 | 21707 | 21726 | AAGCCCCATAAGAACAAAGA | 21 | 2541 |
| 465613 | 26034 | 26053 | TCTCCAGCCTACAGATGACT | 32 | 2542 |
| 465614 | 26035 | 26054 | CTCTCCAGCCTACAGATGAC | 31 | 2543 |
| 465615 | 26036 | 26055 | TCTCTCCAGCCTACAGATGA | 29 | 2544 |
| 465616 | 26037 | 26056 | CTCTCTCCAGCCTACAGATG | 22 | 2545 |
| 465617 | 26038 | 26057 | CCTCTCTCCAGCCTACAGAT | 44 | 2546 |
| 465618 | 26039 | 26058 | TCCTCTCTCCAGCCTACAGA | 41 | 2547 |
| 465619 | 26040 | 26059 | TTCCTCTCTCCAGCCTACAG | 32 | 2548 |
| 465620 | 26041 | 26060 | GTTCCTCTCTCCAGCCTACA | 0 | 2549 |
| 465621 | 26042 | 26061 | AGTTCCTCTCTCCAGCCTAC | 44 | 2550 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465622 | 26043 | 26062 | CAGTTCCTCTCTCCAGCCTA | 39 | 2551 |
| 465623 | 26044 | 26063 | CCAGTTCCTCTCTCCAGCCT | 47 | 2552 |
| 465624 | 26045 | 26064 | TCCAGTTCCTCTCTCCAGCC | 49 | 2553 |
| 465625 | 26046 | 26065 | TTCCAGTTCCTCTCTCCAGC | 46 | 2554 |
| 465626 | 26047 | 26066 | CTTCCAGTTCCTCTCTCCAG | 47 | 2555 |
| 465627 | 26048 | 26067 | CCTTCCAGTTCCTCTCTCCA | 28 | 2556 |
| 465628 | 26049 | 26068 | CCCTTCCAGTTCCTCTCTCC | 28 | 2557 |
| 465629 | 26050 | 26069 | CCCCTTCCAGTTCCTCTCTC | 21 | 2558 |
| 465630 | 26051 | 26070 | GCCCCTTCCAGTTCCTCTCT | 65 | 2559 |
| 465631 | 26052 | 26071 | AGCCCCTTCCAGTTCCTCTC | 60 | 2560 |
| 465632 | 26053 | 26072 | TAGCCCCTTCCAGTTCCTCT | 56 | 2561 |
| 465633 | 26054 | 26073 | TTAGCCCCTTCCAGTTCCTC | 52 | 2562 |
| 465634 | 26055 | 26074 | TTTAGCCCCTTCCAGTTCCT | 53 | 2563 |
| 465635 | 26056 | 26075 | CTTTAGCCCCTTCCAGTTCC | 39 | 2564 |
| 465636 | 26057 | 26076 | ACTTTAGCCCCTTCCAGTTC | 31 | 2565 |
| 465637 | 26058 | 26077 | AACTTTAGCCCCTTCCAGTT | 46 | 2566 |
| 465638 | 26059 | 26078 | CAACTTTAGCCCCTTCCAGT | 37 | 2567 |
| 465639 | 26060 | 26079 | CCAACTTTAGCCCCTTCCAG | 48 | 2568 |
| 455611* | 26061 | 26080 | GCCAACTTTAGCCCCTTCCA | 62 | 1870 |
| 465640 | 26062 | 26081 | AGCCAACTTTAGCCCCTTCC | 71 | 2569 |
| 465641 | 26063 | 26082 | CAGCCAACTTTAGCCCCTTC | 70 | 2570 |
| 465642 | 26064 | 26083 | TCAGCCAACTTTAGCCCCTT | 66 | 2571 |
| 465643 | 26065 | 26084 | CTCAGCCAACTTTAGCCCCT | 35 | 2572 |
| 465644 | 26066 | 26085 | ACTCAGCCAACTTTAGCCCC | 49 | 2573 |
| 465645 | 26067 | 26086 | TACTCAGCCAACTTTAGCCC | 33 | 2574 |
| 465646 | 26068 | 26087 | CTACTCAGCCAACTTTAGCC | 28 | 2575 |
| 465647 | 26069 | 26088 | ACTACTCAGCCAACTTTAGC | 12 | 2576 |
| 465648 | 26070 | 26089 | AACTACTCAGCCAACTTTAG | 34 | 2577 |
| 465649 | 26071 | 26090 | TAACTACTCAGCCAACTTTA | 26 | 2578 |
| 455637* | 37873 | 37892 | GTACTTTACATGTGCAGCAC | 78 | 1931 |
| 465650 | 37874 | 37893 | TGTACTTTACATGTGCAGCA | 71 | 2579 |
| 465651 | 37875 | 37894 | GTGTACTTTACATGTGCAGC | 75 | 2580 |
| 465652 | 37876 | 37895 | TGTGTACTTTACATGTGCAG | 65 | 2581 |
| 465653 | 37877 | 37896 | CTGTGTACTTTACATGTGCA | 65 | 2582 |
| 465654 | 37878 | 37897 | CCTGTGTACTTTACATGTGC | 60 | 2583 |
| 465655 | 37879 | 37898 | TCCTGTGTACTTTACATGTG | 51 | 2584 |
| 465656 | 37880 | 37899 | CTCCTGTGTACTTTACATGT | 48 | 2585 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465657 | 37881 | 37900 | TCTCCTGTGTACTTTACATG | 25 | 2586 |
| 465658 | 37882 | 37901 | ATCTCCTGTGTACTTTACAT | 33 | 2587 |
| 465659 | 37883 | 37902 | AATCTCCTGTGTACTTTACA | 23 | 2588 |
| 465660 | 37884 | 37903 | AAATCTCCTGTGTACTTTAC | 24 | 2589 |
| 465661 | 37885 | 37904 | TAAATCTCCTGTGTACTTTA | 26 | 2590 |
| 465666 | 37886 | 37905 | CTAAATCTCCTGTGTACTTT | 16 | 2591 |
| 465667 | 37887 | 37906 | TCTAAATCTCCTGTGTACTT | 27 | 2592 |
| 465668 | 37888 | 37907 | TTCTAAATCTCCTGTGTACT | 30 | 2593 |
| 465669 | 37889 | 37908 | TTTCTAAATCTCCTGTGTAC | 30 | 2594 |
| 465670 | 37890 | 37909 | TTTTCTAAATCTCCTGTGTA | 11 | 2595 |
| 465671 | 37891 | 37910 | GTTTTCTAAATCTCCTGTGT | 37 | 2596 |
| 465672 | 37892 | 37911 | AGTTTTCTAAATCTCCTGTG | 49 | 2597 |
| 465686 | 37893 | 37912 | AAGTTTTCTAAATCTCCTGT | 19 | 2598 |
| 465687 | 37894 | 37913 | GAAGTTTTCTAAATCTCCTG | 46 | 2599 |
| 465688 | 37895 | 37914 | CGAAGTTTTCTAAATCTCCT | 53 | 2600 |
| 465689 | 37896 | 37915 | ACGAAGTTTTCTAAATCTCC | 45 | 2601 |
| 465690 | 37897 | 37916 | TACGAAGTTTTCTAAATCTC | 9 | 2602 |
| 465706 | 37898 | 37917 | CTACGAAGTTTTCTAAATCT | 14 | 2603 |
| 465707 | 37899 | 37918 | GCTACGAAGTTTTCTAAATC | 32 | 2604 |
| 455677* | 45512 | 45531 | TTCCAATATTTGTACCCTCA | 49 | 1971 |
| 465574 | 45513 | 45532 | TTTCCAATATTTGTACCCTC | 43 | 2605 |
| 465575 | 45514 | 45533 | CTTTCCAATATTTGTACCCT | 50 | 2606 |
| 465576 | 45515 | 45534 | GCTTTCCAATATTTGTACCC | 58 | 2607 |
| 465577 | 45516 | 45535 | TGCTTTCCAATATTTGTACC | 35 | 2608 |
| 465578 | 45517 | 45536 | TTGCTTTCCAATATTTGTAC | 31 | 2609 |
| 465579 | 45518 | 45537 | CTTGCTTTCCAATATTTGTA | 29 | 2610 |
| 465580 | 45519 | 45538 | CCTTGCTTTCCAATATTTGT | 35 | 2611 |
| 465581 | 45520 | 45539 | CCCTTGCTTTCCAATATTTG | 26 | 2612 |
| 465582 | 45521 | 45540 | TCCCTTGCTTTCCAATATTT | 34 | 2613 |
| 465583 | 45522 | 45541 | GTCCCTTGCTTTCCAATATT | 39 | 2614 |
| 465584 | 45523 | 45542 | TGTCCCTTGCTTTCCAATAT | 44 | 2615 |
| 465585 | 45524 | 45543 | CTGTCCCTTGCTTTCCAATA | 60 | 2616 |
| 465586 | 45525 | 45544 | TCTGTCCCTTGCTTTCCAAT | 59 | 2617 |
| 465587 | 45526 | 45545 | TTCTGTCCCTTGCTTTCCAA | 47 | 2618 |
| 455681* | 46091 | 46110 | TTTCCAGATATTTTCCCATA | 48 | 1975 |
| 465335 | 46092 | 46111 | GTTTCCAGATATTTTCCCAT | 71 | 2619 |
| 465336 | 46093 | 46112 | TGTTTCCAGATATTTTCCCA | 53 | 2620 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 466676 | 48396 | 48415 | CTTTCCATTCTAGTTTTACC | 1 | 2621 |
| 466677 | 48397 | 48416 | ACTTTCCATTCTAGTTTTAC | 19 | 2622 |
| 466678 | 48398 | 48417 | CACTTTCCATTCTAGTTTTA | 23 | 2623 |
| 466679 | 48399 | 48418 | ACACTTTCCATTCTAGTTTT | 9 | 2624 |
| 466680 | 48400 | 48419 | CACACTTTCCATTCTAGTTT | 31 | 2625 |
| 466681 | 48401 | 48420 | CCACACTTTCCATTCTAGTT | 64 | 2626 |
| 455703* | 48402 | 48421 | GCCACACTTTCCATTCTAGT | 75 | 1997 |
| 466682 | 48403 | 48422 | AGCCACACTTTCCATTCTAG | 56 | 2627 |
| 466683 | 48404 | 48423 | AAGCCACACTTTCCATTCTA | 40 | 2628 |
| 466684 | 48405 | 48424 | CAAGCCACACTTTCCATTCT | 24 | 2629 |
| 466685 | 48406 | 48425 | TCAAGCCACACTTTCCATTC | 39 | 2630 |
| 466686 | 48407 | 48426 | CTCAAGCCACACTTTCCATT | 38 | 2631 |
| 466687 | 48408 | 48427 | GCTCAAGCCACACTTTCCAT | 53 | 2632 |
| 466688 | 48409 | 48428 | AGCTCAAGCCACACTTTCCA | 59 | 2633 |
| 466689 | 48410 | 48429 | CAGCTCAAGCCACACTTTCC | 51 | 2634 |
| 466690 | 48411 | 48430 | CCAGCTCAAGCCACACTTTC | 43 | 2635 |
| 466691 | 48412 | 48431 | ACCAGCTCAAGCCACACTTT | 30 | 2636 |
| 466692 | 48413 | 48432 | TACCAGCTCAAGCCACACTT | 35 | 2637 |
| 466693 | 48414 | 48433 | TTACCAGCTCAAGCCACACT | 32 | 2638 |
| 466694 | 48415 | 48434 | GTTACCAGCTCAAGCCACAC | 53 | 2639 |
| 466695 | 48416 | 48435 | GGTTACCAGCTCAAGCCACA | 54 | 2640 |
| 455704* | 48417 | 48436 | TGGTTACCAGCTCAAGCCAC | 61 | 1998 |
| 455708* | 48728 | 48747 | CCCACAGTGACAGTGACTCA | 58 | 2002 |
| 465708 | 48729 | 48748 | TCCCACAGTGACAGTGACTC | 61 | 2641 |
| 465709 | 48730 | 48749 | TTCCCACAGTGACAGTGACT | 60 | 2642 |
| 465710 | 48731 | 48750 | CTTCCCACAGTGACAGTGAC | 55 | 2643 |
| 455723* | 52033 | 52052 | ACCAGTTTTCTAGCCGATCT | 24 | 2017 |
| 466696 | 52034 | 52053 | TACCAGTTTTCTAGCCGATC | 54 | 2644 |
| 466697 | 52035 | 52054 | TTACCAGTTTTCTAGCCGAT | 41 | 2645 |
| 466698 | 52036 | 52055 | TTTACCAGTTTTCTAGCCGA | 37 | 2646 |
| 466699 | 52037 | 52056 | CTTTACCAGTTTTCTAGCCG | 17 | 2647 |
| 466700 | 52038 | 52057 | CCTTTACCAGTTTTCTAGCC | 11 | 2648 |
| 466701 | 52039 | 52058 | TCCTTTACCAGTTTTCTAGC | 24 | 2649 |
| 466702 | 52040 | 52059 | ATCCTTTACCAGTTTTCTAG | 1 | 2650 |
| 466703 | 52041 | 52060 | CATCCTTTACCAGTTTTCTA | 7 | 2651 |
| 466704 | 52042 | 52061 | TCATCCTTTACCAGTTTTCT | 0 | 2652 |
| 466705 | 52043 | 52062 | TTCATCCTTTACCAGTTTTC | 15 | 2653 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 466706 | 52044 | 52063 | TTTCATCCTTTACCAGTTTT | 0 | 2654 |
| 466707 | 52045 | 52064 | CTTTCATCCTTTACCAGTTT | 9 | 2655 |
| 466708 | 52046 | 52065 | TCTTTCATCCTTTACCAGTT | 0 | 2656 |
| 466709 | 52047 | 52066 | TTCTTTCATCCTTTACCAGT | 8 | 2657 |
| 466710 | 52048 | 52067 | CTTCTTTCATCCTTTACCAG | 11 | 2658 |
| 466711 | 52049 | 52068 | GCTTCTTTCATCCTTTACCA | 8 | 2659 |
| 466712 | 52050 | 52069 | AGCTTCTTTCATCCTTTACC | 6 | 2660 |
| 466713 | 52051 | 52070 | AAGCTTCTTTCATCCTTTAC | 0 | 2661 |
| 466714 | 52052 | 52071 | AAAGCTTCTTTCATCCTTTA | 18 | 2662 |
| 466715 | 52053 | 52072 | AAAAGCTTCTTTCATCCTTT | 2 | 2663 |
| 466716 | 52054 | 52073 | GAAAAGCTTCTTTCATCCTT | 9 | 2664 |
| 466717 | 52055 | 52074 | GGAAAAGCTTCTTTCATCCT | 1 | 2665 |
| 455724* | 52056 | 52075 | AGGAAAAGCTTCTTTCATCC | 0 | 2018 |
| 455762* | 59913 | 59932 | CCAAGTGTTTGAATTCTGCA | 36 | 2056 |
| 466766 | 59914 | 59933 | ACCAAGTGTTTGAATTCTGC | 58 | 2666 |
| 466767 | 59915 | 59934 | TACCAAGTGTTTGAATTCTG | 32 | 2667 |
| 466768 | 59916 | 59935 | ATACCAAGTGTTTGAATTCT | 21 | 2668 |
| 466769 | 59917 | 59936 | CATACCAAGTGTTTGAATTC | 9 | 2669 |
| 466770 | 59918 | 59937 | ACATACCAAGTGTTTGAATT | 14 | 2670 |
| 466771 | 59919 | 59938 | CACATACCAAGTGTTTGAAT | 26 | 2671 |
| 466772 | 59920 | 59939 | CCACATACCAAGTGTTTGAA | 8 | 2672 |
| 466773 | 59921 | 59940 | CCCACATACCAAGTGTTTGA | 19 | 2673 |
| 466774 | 59922 | 59941 | TCCCACATACCAAGTGTTTG | 5 | 2674 |
| 466775 | 59923 | 59942 | CTCCCACATACCAAGTGTTT | 25 | 2675 |
| 466776 | 59924 | 59943 | CCTCCCACATACCAAGTGTT | 32 | 2676 |
| 466777 | 59925 | 59944 | TCCTCCCACATACCAAGTGT | 12 | 2677 |
| 466778 | 59926 | 59945 | CTCCTCCCACATACCAAGTG | 10 | 2678 |
| 466779 | 59927 | 59946 | GCTCCTCCCACATACCAAGT | 15 | 2679 |
| 466780 | 59928 | 59947 | AGCTCCTCCCACATACCAAG | 5 | 2680 |
| 466781 | 59929 | 59948 | GAGCTCCTCCCACATACCAA | 23 | 2681 |
| 465768 | 61325 | 61344 | CAGTCTAGAATAGCCATGGA | 71 | 2682 |
| 465769 | 61326 | 61345 | ACAGTCTAGAATAGCCATGG | 72 | 2683 |
| 465770 | 61327 | 61346 | GACAGTCTAGAATAGCCATG | 78 | 2684 |
| 465771 | 61328 | 61347 | AGACAGTCTAGAATAGCCAT | 74 | 2685 |
| 465772 | 61329 | 61348 | GAGACAGTCTAGAATAGCCA | 70 | 2686 |
| 465773 | 61330 | 61349 | AGAGACAGTCTAGAATAGCC | 70 | 2687 |
| 465774 | 61331 | 61350 | CAGAGACAGTCTAGAATAGC | 63 | 2688 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465775 | 61332 | 61351 | ACAGAGACAGTCTAGAATAG | 55 | 2689 |
| 465776 | 61333 | 61352 | CACAGAGACAGTCTAGAATA | 64 | 2690 |
| 465777 | 61334 | 61353 | TCACAGAGACAGTCTAGAAT | 71 | 2691 |
| 465778 | 61335 | 61354 | ATCACAGAGACAGTCTAGAA | 79 | 2692 |
| 465779 | 61336 | 61355 | TATCACAGAGACAGTCTAGA | 66 | 2693 |
| 465780 | 61337 | 61356 | ATATCACAGAGACAGTCTAG | 64 | 2694 |
| 465781 | 61338 | 61357 | AATATCACAGAGACAGTCTA | 48 | 2695 |
| 465782 | 61339 | 61358 | AAATATCACAGAGACAGTCT | 65 | 2696 |
| 455786* | 61340 | 61359 | CAAATATCACAGAGACAGTC | 63 | 2070 |
| 465783 | 61341 | 61360 | GCAAATATCACAGAGACAGT | 69 | 2697 |
| 465786 | 61342 | 61361 | TGCAAATATCACAGAGACAG | 78 | 2698 |
| 465787 | 61343 | 61362 | ATGCAAATATCACAGAGACA | 72 | 2699 |
| 465788 | 61344 | 61363 | AATGCAAATATCACAGAGAC | 59 | 2700 |
| 465789 | 61345 | 61364 | AAATGCAAATATCACAGAGA | 23 | 2701 |
| 465790 | 61346 | 61365 | AAAATGCAAATATCACAGAG | 28 | 2702 |
| 465791 | 61347 | 61366 | TAAAATGCAAATATCACAGA | 0 | 2703 |
| 465792 | 61348 | 61367 | TTAAAATGCAAATATCACAG | 12 | 2704 |
| 465793 | 61349 | 61368 | TTTAAAATGCAAATATCACA | 3 | 2705 |
| 465794 | 61350 | 61369 | GTTTAAAATGCAAATATCAC | 2 | 2706 |
| 465795 | 61351 | 61370 | AGTTTAAAATGCAAATATCA | 0 | 2707 |
| 465796 | 61352 | 61371 | CAGTTTAAAATGCAAATATC | 13 | 2708 |
| 465797 | 61353 | 61372 | TCAGTTTAAAATGCAAATAT | 0 | 2709 |
| 465798 | 61354 | 61373 | TTCAGTTTAAAATGCAAATA | 0 | 2710 |
| 465799 | 61355 | 61374 | ATTCAGTTTAAAATGCAAAT | 1 | 2711 |
| 465800 | 61356 | 61375 | TATTCAGTTTAAAATGCAAA | 0 | 2712 |
| 465801 | 61357 | 61376 | ATATTCAGTTTAAAATGCAA | 0 | 2713 |
| 455790* | 62043 | 62062 | CATGGTTATGTGTATCTGCA | 69 | 2074 |
| 465337 | 62044 | 62063 | ACATGGTTATGTGTATCTGC | 69 | 2714 |
| 465338 | 62045 | 62064 | CACATGGTTATGTGTATCTG | 40 | 2715 |
| 465339 | 62046 | 62065 | CCACATGGTTATGTGTATCT | 32 | 2716 |
| 337332 | 66135 | 66154 | GAAGCCCTTGCCAGCCATGT | 79 | 1541 |
| 455840* | 71610 | 71629 | GTACAATTGCTTCAACTAGA | 81 | 2124 |
| 466782 | 71611 | 71630 | AGTACAATTGCTTCAACTAG | 54 | 2717 |
| 466783 | 71612 | 71631 | CAGTACAATTGCTTCAACTA | 68 | 2718 |
| 466784 | 71613 | 71632 | GCAGTACAATTGCTTCAACT | 72 | 2719 |
| 465588 | 71614 | 71633 | GGCAGTACAATTGCTTCAAC | 69 | 2720 |
| 455264* | 74768 | 74787 | TCCTTAAACCTTCCTATTTC | 26 | 1563 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465226 | 74769 | 74788 | CTCCTTAAACCTTCCTATTT | 45 | 2721 |
| 455265* | 74770 | 74789 | TCTCCTTAAACCTTCCTATT | 57 | 1564 |
| 465227 | 74771 | 74790 | TTCTCCTTAAACCTTCCTAT | 54 | 2722 |
| 455266* | 74772 | 74791 | ATTCTCCTTAAACCTTCCTA | 52 | 1565 |
| 465228 | 74773 | 74792 | GATTCTCCTTAAACCTTCCT | 64 | 2723 |
| 455267* | 74774 | 74793 | AGATTCTCCTTAAACCTTCC | 60 | 1566 |
| 465229 | 74775 | 74794 | TAGATTCTCCTTAAACCTTC | 22 | 2724 |
| 455268* | 74776 | 74795 | TTAGATTCTCCTTAAACCTT | 55 | 1567 |
| 465230 | 74777 | 74796 | CTTAGATTCTCCTTAAACCT | 69 | 2725 |
| 455269* | 74778 | 74797 | GCTTAGATTCTCCTTAAACC | 84 | 1568 |
| 465231 | 74779 | 74798 | TGCTTAGATTCTCCTTAAAC | 64 | 2726 |
| 455270* | 74780 | 74799 | ATGCTTAGATTCTCCTTAAA | 50 | 1569 |
| 465232 | 74781 | 74800 | AATGCTTAGATTCTCCTTAA | 71 | 2727 |
| 455271* | 74782 | 74801 | AAATGCTTAGATTCTCCTTA | 69 | 1570 |
| 465233 | 74783 | 74802 | AAAATGCTTAGATTCTCCTT | 69 | 2728 |
| 455272* | 74784 | 74803 | TAAAATGCTTAGATTCTCCT | 56 | 1571 |
| 455281* | 74872 | 74891 | CAAGGTTGTAAGCACCCTCT | 63 | 1580 |
| 465234 | 74873 | 74892 | TCAAGGTTGTAAGCACCCTC | 54 | 2729 |
| 455282* | 74874 | 74893 | GTCAAGGTTGTAAGCACCCT | 8 | 1581 |
| 465235 | 74875 | 74894 | AGTCAAGGTTGTAAGCACCC | 65 | 2730 |
| 455283* | 74876 | 74895 | GAGTCAAGGTTGTAAGCACC | 48 | 1582 |
| 455290* | 74900 | 74919 | GCAGATCAAGTCCAGGGAGA | 77 | 1589 |
| 465236 | 74901 | 74920 | AGCAGATCAAGTCCAGGGAG | 80 | 2731 |
| 455291* | 74902 | 74921 | CAGCAGATCAAGTCCAGGGA | 82 | 1590 |
| 465237 | 74903 | 74922 | ACAGCAGATCAAGTCCAGGG | 82 | 2732 |
| 455292* | 74904 | 74923 | AACAGCAGATCAAGTCCAGG | 69 | 1591 |
| 455369* | 75418 | 75437 | GGTGTTCCCATACGCACAGG | 75 | 1668 |
| 465238 | 75419 | 75438 | AGGTGTTCCCATACGCACAG | 68 | 2733 |
| 455370* | 75420 | 75439 | TAGGTGTTCCCATACGCACA | 67 | 1669 |
| 465239 | 75421 | 75440 | CTAGGTGTTCCCATACGCAC | 82 | 2734 |
| 455371* | 75422 | 75441 | GCTAGGTGTTCCCATACGCA | 85 | 1670 |
| 465240 | 75423 | 75442 | TGCTAGGTGTTCCCATACGC | 77 | 2735 |
| 455372* | 75424 | 75443 | GTGCTAGGTGTTCCCATACG | 72 | 1671 |
| 455390* | 75616 | 75635 | AACTGTCTCCAGGCAGGAGG | 65 | 1689 |
| 465241 | 75617 | 75636 | CAACTGTCTCCAGGCAGGAG | 51 | 2736 |
| 455391* | 75618 | 75637 | TCAACTGTCTCCAGGCAGGA | 52 | 1690 |
| 465242 | 75619 | 75638 | ATCAACTGTCTCCAGGCAGG | 76 | 2737 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 455392* | 75620 | 75639 | CATCAACTGTCTCCAGGCAG | 63 | 1691 |
| 465243 | 75621 | 75640 | ACATCAACTGTCTCCAGGCA | 70 | 2738 |
| 455393* | 75622 | 75641 | CACATCAACTGTCTCCAGGC | 75 | 1692 |
| 465244 | 75623 | 75642 | ACACATCAACTGTCTCCAGG | 61 | 2739 |
| 455394* | 75624 | 75643 | GACACATCAACTGTCTCCAG | 69 | 1693 |
| 455397* | 75662 | 75681 | TACTGAAGAGTGTTGCTGGA | 77 | 1696 |
| 465245 | 75663 | 75682 | GTACTGAAGAGTGTTGCTGG | 84 | 2740 |
| 455398* | 75664 | 75683 | TGTACTGAAGAGTGTTGCTG | 76 | 1697 |
| 465246 | 75665 | 75684 | ATGTACTGAAGAGTGTTGCT | 72 | 2741 |
| 455399* | 75666 | 75685 | TATGTACTGAAGAGTGTTGC | 70 | 1698 |
| 455411* | 75726 | 75745 | AACCCAATGGTAAGCCCAAG | 77 | 1710 |
| 465247 | 75727 | 75746 | AAACCCAATGGTAAGCCCAA | 61 | 2742 |
| 455412* | 75728 | 75747 | TAAACCCAATGGTAAGCCCA | 72 | 1711 |
| 465248 | 75729 | 75748 | TTAAACCCAATGGTAAGCCC | 69 | 2743 |
| 455413* | 75730 | 75749 | TTTAAACCCAATGGTAAGCC | 38 | 1712 |
| 455428* | 75829 | 75848 | TACAATCAGAGTTAAGACCA | 58 | 1727 |
| 465249 | 75830 | 75849 | CTACAATCAGAGTTAAGACC | 58 | 2744 |
| 455429* | 75831 | 75850 | GCTACAATCAGAGTTAAGAC | 71 | 1728 |
| 465250 | 75832 | 75851 | TGCTACAATCAGAGTTAAGA | 59 | 2745 |
| 455430* | 75833 | 75852 | TTGCTACAATCAGAGTTAAG | 47 | 1729 |
| 455437* | 75847 | 75866 | TCCTCTCAGAACTTTTGCTA | 36 | 1736 |
| 465251 | 75848 | 75867 | CTCCTCTCAGAACTTTTGCT | 47 | 2746 |
| 455438* | 75849 | 75868 | GCTCCTCTCAGAACTTTTGC | 75 | 1737 |
| 465252 | 75850 | 75869 | AGCTCCTCTCAGAACTTTTG | 71 | 2747 |
| 455439* | 75851 | 75870 | CAGCTCCTCTCAGAACTTTT | 68 | 1738 |
| 465253 | 75852 | 75871 | TCAGCTCCTCTCAGAACTTT | 62 | 2748 |
| 455440* | 75853 | 75872 | CTCAGCTCCTCTCAGAACTT | 58 | 1739 |
| 455446* | 75965 | 75984 | GTAGGTAAGCAACCCACGGG | 69 | 1745 |
| 465254 | 75966 | 75985 | GGTAGGTAAGCAACCCACGG | 79 | 2749 |
| 455447* | 75967 | 75986 | AGGTAGGTAAGCAACCCACG | 80 | 1476 |
| 465255 | 75968 | 75987 | TAGGTAGGTAAGCAACCCAC | 84 | 2750 |
| 455448* | 75969 | 75988 | ATAGGTAGGTAAGCAACCCA | 71 | 1474 |
| 455456* | 75985 | 76004 | GCTTATAAACCACCTTATAG | 37 | 1755 |
| 465256 | 75986 | 76005 | AGCTTATAAACCACCTTATA | 43 | 2751 |
| 455457* | 75987 | 76006 | CAGCTTATAAACCACCTTAT | 57 | 1756 |
| 465257 | 75988 | 76007 | GCAGCTTATAAACCACCTTA | 73 | 2752 |
| 455458* | 75989 | 76008 | AGCAGCTTATAAACCACCTT | 75 | 1757 |

TABLE 55-continued

Inhibition of human STAT3 mRNA levels by chimeric antisense oligonucleotides targeted to SEQ ID NO: 2

| ISIS No | Start Site | Stop Site | Sequence | % inhibition | SEQ ID NO |
|---|---|---|---|---|---|
| 465258 | 75990 | 76009 | CAGCAGCTTATAAACCACCT | 65 | 2753 |
| 455459* | 75991 | 76010 | ACAGCAGCTTATAAACCACC | 46 | 1758 |
| 455462* | 75997 | 76016 | GCCAGGACAGCAGCTTATAA | 70 | 1761 |
| 466718 | 75998 | 76017 | GGCCAGGACAGCAGCTTATA | 87 | 2754 |
| 455463* | 75999 | 76018 | TGGCCAGGACAGCAGCTTAT | 83 | 1762 |
| 466719 | 76000 | 76019 | GTGGCCAGGACAGCAGCTTA | 76 | 2755 |
| 455464* | 76001 | 76020 | AGTGGCCAGGACAGCAGCTT | 82 | 1763 |
| 455470* | 76013 | 76032 | GAATTTGAATGCAGTGGCCA | 75 | 1769 |
| 466720 | 76014 | 76033 | GGAATTTGAATGCAGTGGCC | 87 | 2756 |
| 455471* | 76015 | 76034 | TGGAATTTGAATGCAGTGGC | 75 | 1770 |
| 466721 | 76016 | 76035 | TTGGAATTTGAATGCAGTGG | 72 | 2757 |
| 455472* | 76017 | 76036 | ATTGGAATTTGAATGCAGTG | 60 | 1771 |

Example 35

Dose-Dependent Antisense Inhibition of Human STAT3 in HuVEC Cells

Gapmers from the study described in Example 3 exhibiting significant in vitro inhibition of STAT3 were tested at various doses in HuVEC cells. Cells were plated at a density of 5,000 cells per well and transfected using LipofectAMINE2000® reagent with 8.8 nM, 17.5 nM, 35.0 nM, and 70.0 nM concentrations of antisense oligonucleotide, as specified in Table 56. After a treatment period of approximately 16 hours, RNA was isolated from the cells and STAT3 mRNA levels were measured by quantitative real-time PCR. Human STAT3 primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

As illustrated in Table 56, STAT3 mRNA levels were reduced in a dose-dependent manner in antisense oligonucleotide treated cells.

TABLE 56

Dose-dependent antisense inhibition of human STAT3 in HuVEC cells using LipofectAMINE 2000 ® reagent

| ISIS No | 8.8 nM | 17.5 nM | 35.0 nM | 70.0 nM |
|---|---|---|---|---|
| 337332 | 50 | 71 | 81 | 88 |
| 455269 | 62 | 69 | 79 | 82 |
| 455291 | 72 | 81 | 87 | 88 |
| 455371 | 71 | 83 | 88 | 90 |
| 455447 | 53 | 70 | 81 | 79 |
| 455463 | 68 | 79 | 84 | 87 |
| 455464 | 69 | 78 | 84 | 86 |
| 455471 | 62 | 82 | 88 | 90 |
| 455547 | 43 | 64 | 75 | 87 |
| 455565 | 41 | 73 | 83 | 92 |
| 455582 | 50 | 67 | 81 | 87 |
| 455637 | 50 | 65 | 79 | 85 |
| 455703 | 45 | 65 | 81 | 85 |
| 455840 | 58 | 70 | 80 | 85 |
| 465236 | 62 | 76 | 81 | 85 |
| 465237 | 67 | 81 | 86 | 90 |
| 465239 | 64 | 77 | 85 | 92 |
| 465240 | 50 | 66 | 76 | 83 |
| 465245 | 70 | 81 | 87 | 87 |
| 465254 | 54 | 75 | 81 | 86 |
| 465255 | 63 | 74 | 84 | 85 |
| 465335 | 46 | 62 | 74 | 80 |
| 465449 | 49 | 71 | 84 | 84 |
| 465458 | 54 | 73 | 84 | 88 |
| 465509 | 66 | 80 | 86 | 83 |
| 465510 | 48 | 66 | 76 | 82 |
| 465511 | 56 | 68 | 75 | 79 |
| 465526 | 53 | 68 | 76 | 76 |
| 465537 | 41 | 60 | 77 | 85 |
| 465588 | 52 | 73 | 76 | 79 |
| 465610 | 35 | 57 | 71 | 79 |
| 465730 | 51 | 75 | 85 | 87 |
| 465739 | 72 | 81 | 88 | 90 |
| 465740 | 70 | 81 | 86 | 89 |
| 465742 | 63 | 76 | 87 | 88 |
| 465748 | 48 | 62 | 67 | 74 |
| 465751 | 70 | 81 | 87 | 87 |
| 465752 | 76 | 82 | 88 | 89 |
| 465754 | 70 | 83 | 86 | 87 |
| 465755 | 70 | 81 | 85 | 89 |
| 465770 | 52 | 69 | 77 | 77 |
| 465771 | 40 | 55 | 64 | 75 |
| 465778 | 40 | 69 | 75 | 77 |
| 465786 | 56 | 71 | 76 | 83 |
| 465830 | 66 | 77 | 83 | 82 |
| 465833 | 50 | 67 | 79 | 86 |
| 465834 | 42 | 67 | 77 | 81 |
| 465886 | 58 | 73 | 83 | 87 |
| 465888 | 49 | 68 | 82 | 12 |
| 465926 | 43 | 64 | 76 | 82 |

TABLE 56-continued

Dose-dependent antisense inhibition of human STAT3 in HuVEC cells using LipofectAMINE 2000 ® reagent

| ISIS No | 8.8 nM | 17.5 nM | 35.0 nM | 70.0 nM |
|---|---|---|---|---|
| 466661 | 47 | 63 | 80 | 84 |
| 466666 | 39 | 66 | 80 | 86 |
| 466670 | 73 | 83 | 89 | 90 |
| 466718 | 73 | 78 | 84 | 85 |
| 466719 | 63 | 73 | 83 | 83 |
| 466720 | 80 | 87 | 86 | 86 |

Example 36

Dose-Dependent Antisense Inhibition of Human STAT3 in HuVEC Cells

Gapmers from the study described in Example 3 were further tested at various doses in HuVEC cells. Cells were plated at a density of 20,000 cells per well and transfected using electroporation with 187.5 nM, 375.0 nM, 750.0 nM, 1,500.0 nM, 3,000.0 nM, and 6,000.0 nM concentrations of antisense oligonucleotide, as specified in Table 57. After a treatment period of approximately 16 hours, RNA was isolated from the cells and STAT3 mRNA levels were measured by quantitative real-time PCR. Human STAT3 primer probe set RTS199, described hereinabove, was used to measure mRNA levels. STAT3 mRNA levels were adjusted according to total RNA content, as measured by RIBOGREEN®. Results are presented as percent inhibition of STAT3, relative to untreated control cells.

As illustrated in Table 57, STAT3 mRNA levels were significantly reduced in a dose-dependent manner in antisense oligonucleotide treated cells.

TABLE 57

Dose-dependent antisense inhibition of human STAT3 in HuVEC cells using electroporation

| ISIS No | 187.5 nM | 375.0 nM | 750.0 nM | 1500.0 nM | 3000.0 nM | 6000.0 nM | IC$_{50}$ (µM) |
|---|---|---|---|---|---|---|---|
| 337332 | 35 | 51 | 73 | 84 | 97 | 98 | 0.3 |
| 455269 | 64 | 76 | 87 | 89 | 92 | 90 | <0.2 |
| 455291 | 63 | 79 | 88 | 90 | 90 | 93 | <0.2 |
| 455371 | 50 | 81 | 90 | 94 | 96 | 95 | <0.2 |
| 455447 | 37 | 49 | 61 | 91 | 94 | 96 | 0.3 |
| 455463 | 57 | 78 | 89 | 93 | 95 | 94 | <0.2 |
| 455464 | 57 | 67 | 78 | 80 | 79 | 87 | <0.2 |
| 455471 | 50 | 73 | 81 | 86 | 91 | 92 | <0.2 |
| 455547 | 19 | 49 | 63 | 82 | 92 | 94 | 0.5 |
| 455582 | 42 | 62 | 82 | 92 | 97 | 97 | 0.2 |
| 455637 | 44 | 60 | 63 | 87 | 91 | 92 | 0.2 |
| 455840 | 39 | 58 | 75 | 81 | 88 | 89 | 0.2 |
| 465236 | 56 | 67 | 71 | 83 | 91 | 92 | <0.2 |
| 465237 | 56 | 75 | 87 | 92 | 94 | 93 | <0.2 |
| 465239 | 60 | 78 | 88 | 95 | 99 | 99 | <0.2 |
| 465240 | 49 | 67 | 80 | 85 | 94 | 95 | 0.1 |
| 465245 | 54 | 67 | 81 | 86 | 90 | 90 | <0.2 |
| 465254 | 28 | 50 | 63 | 76 | 91 | 92 | 0.4 |
| 465255 | 46 | 55 | 78 | 89 | 92 | 94 | 0.2 |
| 465335 | 25 | 52 | 65 | 89 | 95 | 95 | 0.4 |
| 465449 | 28 | 56 | 78 | 72 | 96 | 96 | 0.3 |
| 465458 | 19 | 68 | 84 | 91 | 96 | 97 | 0.3 |
| 465509 | 42 | 68 | 77 | 84 | 88 | 88 | 0.1 |
| 465510 | 15 | 43 | 60 | 73 | 85 | 88 | 0.6 |
| 465511 | 19 | 39 | 47 | 68 | 79 | 86 | 0.8 |
| 465526 | 15 | 39 | 54 | 64 | 82 | 84 | 0.8 |
| 465537 | 44 | 65 | 82 | 90 | 95 | 90 | 0.1 |
| 465565 | 12 | 45 | 62 | 80 | 93 | 97 | 0.6 |
| 465588 | 44 | 66 | 82 | 85 | 85 | 87 | 0.1 |
| 465610 | 33 | 56 | 72 | 89 | 96 | 97 | 0.3 |
| 465730 | 48 | 51 | 72 | 91 | 94 | 91 | 0.2 |
| 465739 | 42 | 78 | 85 | 93 | 96 | 92 | 0.9 |
| 465740 | 54 | 69 | 80 | 96 | 98 | 98 | <0.2 |
| 465742 | 67 | 55 | 91 | 93 | 87 | 93 | <0.2 |
| 465748 | 49 | 67 | 88 | 96 | 98 | 99 | 0.1 |
| 465751 | 56 | 63 | 82 | 91 | 98 | 98 | 0.1 |
| 465752 | 62 | 79 | 84 | 93 | 96 | 90 | <0.2 |
| 465754 | 41 | 69 | 84 | 63 | 94 | 93 | <0.2 |
| 465755 | 47 | 56 | 67 | 83 | 93 | 97 | 0.2 |
| 465770 | 52 | 54 | 70 | 85 | 88 | 83 | 0.2 |
| 465771 | 38 | 62 | 76 | 83 | 84 | 86 | 0.2 |
| 465778 | 40 | 58 | 79 | 84 | 96 | 96 | 0.2 |
| 465786 | 41 | 68 | 88 | 94 | 95 | 93 | 0.1 |
| 465830 | 50 | 73 | 89 | 93 | 88 | 92 | <0.2 |
| 465833 | 27 | 44 | 76 | 89 | 88 | 97 | 0.4 |
| 465834 | 8 | 27 | 57 | 80 | 93 | 97 | 0.7 |
| 465886 | 58 | 79 | 90 | 97 | 98 | 96 | <0.2 |
| 465888 | 39 | 60 | 65 | 90 | 94 | 97 | 0.3 |
| 465926 | 23 | 50 | 41 | 85 | 93 | 94 | 0.5 |
| 466661 | 31 | 58 | 76 | 90 | 95 | 96 | 0.3 |
| 466666 | 44 | 55 | 79 | 92 | 96 | 97 | 0.2 |
| 466670 | 50 | 54 | 82 | 96 | 96 | 96 | 0.2 |
| 466718 | 55 | 79 | 90 | 93 | 95 | 96 | <0.2 |
| 466719 | 44 | 52 | 73 | 65 | 87 | 91 | 0.3 |
| 466720 | 48 | 78 | 90 | 90 | 90 | 90 | <0.2 |

Example 37

Tolerability of Antisense Oligonucleotides Targeting Human STAT3 in Cd1 Mice Thirty-nine antisense oligonucleotides exhibiting a high level of potency were further tested for in vivo tolerability.

Groups of eight male CD1 mice were injected subcutaneously twice a week for 6 weeks with 50 mg/kg of ISIS antisense oligonucleotides. One group of eight male CD1 mice was injected subcutaneously twice a week for 6 weeks with PBS. This group served as the control group. Three days after the last dose mice were euthanized and organs and plasma were harvested for further analysis. Liver, spleen, and kidney weights were measured at the end of the study and were compared to PBS treated mice.

To evaluate the effect of ISIS oligonucleotides on hepatic function, plasma concentrations of transaminases were measured using an automated clinical chemistry analyzer (Hitachi Olympus AU400e, Melville, N.Y.). Plasma concentrations of ALT (alanine transaminase) and AST (aspartate transaminase) were measured.

To evaluate the effect of ISIS oligonucleotides on kidney function, plasma concentrations of blood urea nitrogen (BUN) were measured using an automated clinical chemistry analyzer (Hitachi Olympus AU400e, Melville, N.Y.).

Blood obtained from all mice groups were sent to Antech Diagnostics for hematocrit (HCT), mean corpuscular volume (MCV), mean corpuscular hemoglobin (MCH), and mean corpuscular hemoglobin concentration (MCHC) measurements and analyses, as well as measurements of the differential blood cell counts, such as that of WBC, RBC, and total hemoglobin content.

Among the 39 antisense oligonucleotides tested, certain antisense oligonucleotides, including ISIS 455265, ISIS 455269, ISIS 455271, ISIS 455272, ISIS 455291, ISIS 455371, ISIS 455394, ISIS 455703, ISIS 455429, ISIS 455471, ISIS 455527, ISIS 455530, ISIS 455536, ISIS 455548, ISIS 455611, ISIS 465236, ISIS 465237, ISIS 465588, ISIS 465740, ISIS 465754, ISIS 465830, ISIS 466670, and ISIS 466720 met tolerability thresholds for organ weight, ALT, AST, BUN, and hematological parameters.

Example 38

Measurement of Half-Life of Antisense Oligonucleotide in CD1 Mouse Liver

CD1 mice were treated with ISIS antisense oligonucleotides described and the oligonucleotide half-life in the liver was evaluated.

Treatment

Groups of twelve CD1 mice each were injected subcutaneously twice per week for 2 weeks with 50 mg/kg of ISIS 455265, ISIS 455269, ISIS 455271, ISIS 455272, ISIS 455291, ISIS 455371, ISIS 455393, ISIS 455553, ISIS 455582, ISIS 455703, ISIS 455394, ISIS 455429, ISIS 455438, ISIS 455471, ISIS 455527, ISIS 455530, ISIS 455536, ISIS 455540, ISIS 455548, ISIS 455611, ISIS 455429, ISIS 455463, ISIS 455464, ISIS 455471, ISIS 455527, ISIS 455611, ISIS 465236, ISIS 465237, ISIS 465239, ISIS 465588, ISIS 465740, ISIS 465742, ISIS 465751, ISIS 465752, ISIS 465754, ISIS 465830, ISIS 466670, ISIS 466718, and ISIS 466720. Four mice from each group were sacrificed 3 days, 28 days, and 56 days following the final dose. Livers were harvested for analysis.

Measurement of Oligonucleotide Concentration

The concentration of the full-length oligonucleotide as well as the total oligonucleotide concentration (including the degraded form) was measured. The method used is a modification of previously published methods (Leeds et al., 1996; Geary et al., 1999), which includes a phenol-chloroform (liquid-liquid) extraction followed by a solid phase extraction. An internal standard (ISIS 355868, a 27-mer 2'-O-methoxyethyl modified phosphorothioate oligonucleotide, GCGTTTGCTCTTCTTCTTGCGTTTTT, designated herein as SEQ ID NO: 2758) was added prior to extraction. Tissue sample concentrations were calculated using calibration curves, with a lower limit of quantitation (LLOQ) of approximately 1.14 µg/g. Half-lives were then calculated using WinNonlin software (PHARSIGHT).

The half-life of each oligonucleotide is presented in Table 58. Antisense oligonucleotides with half-lives within 11-34 days were chosen for further studies.

TABLE 58

Half-life of ISIS oligonucleotides in the liver of CD1 mice

| ISIS No | Half-life (days) |
|---|---|
| 455265 | 12 |
| 455269 | 48 |
| 455271 | 16 |
| 455272 | 16 |
| 455291 | 19 |
| 455371 | 28 |
| 455394 | 17 |
| 455703 | 27 |
| 455429 | 15 |
| 455471 | 15 |
| 455527 | 13 |
| 455530 | 12 |
| 455536 | 20 |
| 455548 | 13 |
| 455611 | 37 |

TABLE 58-continued

Half-life of ISIS oligonucleotides in the liver of CD1 mice

| ISIS No | Half-life (days) |
|---|---|
| 465236 | 22 |
| 465237 | 17 |
| 465588 | 14 |
| 465740 | 15 |
| 465754 | 23 |
| 465830 | 23 |
| 466670 | 11 |
| 466720 | 17 |

Example 39

Tolerability of Antisense Oligonucleotides Targeting Human STAT3 in Sprague-Dawley Rats Twenty-three antisense oligonucleotides exhibiting a high level of potency were further tested for in vivo tolerability.

Groups of four Sprague-Dawley rats were injected subcutaneously twice a week for 6 weeks with 50 mg/kg of ISIS antisense oligonucleotides. One group of rats was injected subcutaneously twice a week for 6 weeks with PBS. This group served as the control group. Three days after the last dose rats were euthanized and organs and plasma were harvested for further analysis. Liver, spleen, and kidney weights were measured at the end of the study and were compared to PBS treated rats To evaluate the effect of ISIS oligonucleotides on hepatic function, plasma concentrations of transaminases were measured using an automated clinical chemistry analyzer (Hitachi Olympus AU400e, Melville, N.Y.). Plasma concentrations of AST (aspartate transaminase) and total bilirubin were measured.

To evaluate the effect of ISIS oligonucleotides on kidney function, BUN, total urine protein, and creatinine were measured using an automated clinical chemistry analyzer (Hitachi Olympus AU400e, Melville, N.Y.).

Among the 23 antisense oligonucleotides tested, certain antisense oligonucleotides, including ISIS 455269, ISIS 455291, ISIS 455371, ISIS 455703, ISIS 455429, ISIS 465236, ISIS 465237, ISIS 465754, ISIS 465830, and ISIS 466670 met tolerability thresholds for organ weight, AST, bilirubin, BUN, total urine protein, and creatinine.

Example 40

Measurement of Half-Life of Antisense Oligonucleotide in Sprague-Dawley Rat Liver and Kidney Sprague Dawley rats were treated with ISIS antisense oligonucleotides and the oligonucleotide half-life as well as the elapsed time for oligonucleotide degradation and elimination from the liver and kidney was evaluated.

Treatment

Groups of four Sprague Dawley rats each were injected subcutaneously twice a week for 2 weeks with 20 mg/kg of ISIS 455265, ISIS 455269, ISIS 455271, ISIS 455272, ISIS 455291, ISIS 455371, ISIS 455394, ISIS 455703, ISIS 455429, ISIS 455471, ISIS 455527, ISIS 455530, ISIS 455536, ISIS 455548, ISIS 455611, ISIS 465236, ISIS 465237, ISIS 465588, ISIS 465740, ISIS 465754, ISIS 465830, ISIS 466670, and ISIS 466720. Three days after the last dose, the rats were sacrificed and livers and kidneys were collected for analysis.

Measurement of Oligonucleotide Concentration

The concentration of the full-length oligonucleotide as well as the total oligonucleotide concentration (including the degraded form) was measured. The method used is a modification of previously published methods (Leeds et al., 1996; Geary et al., 1999), which includes a phenol-chloroform (liquid-liquid) extraction followed by a solid phase extraction. An internal standard (ISIS 355868, a 27-mer methoxyethyl modified phosphorothioate oligonucleotide, GCGTTTGCTCTTCTTCTTGCGTTTTTT, designated herein as SEQ ID NO: 2758) was added prior to extraction. Tissue sample concentrations were calculated using calibration curves, with a lower limit of quantitation (LLOQ) of approximately 1.14 µg/g. The kidney to liver ratio of the full-length oligonucleotide concentration, as well as that for the total oligonucleotide concentration were calculated. The results are presented in Table 59.

TABLE 59

Kidney to liver ratio of full-length and total oligonucleotide concentrations in Sprague-Dawley rats

| ISIS No | Full length | Total |
|---|---|---|
| 455265 | 3.6 | 3.8 |
| 455269 | 2.1 | 2.4 |
| 455271 | 3.1 | 3.0 |
| 455272 | 2.9 | 3.1 |
| 455291 | 2.7 | 3.3 |
| 455371 | 2.2 | 2.4 |
| 455394 | 1.8 | 2.2 |
| 455703 | 2.3 | 2.8 |
| 455429 | 3.8 | 3.9 |
| 455471 | 2.7 | 2.9 |
| 455527 | 5.0 | 3.9 |
| 455530 | 3.9 | 2.9 |
| 455536 | 3.5 | 3.6 |
| 455548 | 2.5 | 2.9 |
| 455611 | 2.3 | 2.3 |
| 465236 | 2.3 | 3.3 |
| 465237 | 2.4 | 2.7 |
| 465588 | 2.8 | 2.6 |
| 465740 | 2.4 | 2.6 |
| 465754 | 1.6 | 1.8 |
| 465830 | 5.1 | 2.6 |
| 466670 | 3.1 | 4.4 |
| 466720 | 2.3 | 2.6 |

Example 41

Dose-Dependent Antisense Inhibition of STAT3 Following Free Uptake of Antisense Oligonucleotide in SK-BR-3 Cells Gapmers from the rodent tolerability studies described in Examples 6-9 were tested at various doses in SK-BR-3 cells. Cells were plated at a density of 4,000 cells per well. Cells were incubated without any transfection reagent with 0.02 µM, 0.10 µM, 0.50 µM, 1.00 µM, 2.50 µM, and 10.00 µM concentrations of antisense oligonucleotide, as specified in Table 60. After approximately 24 hours, RNA was isolated from the cells and STAT3 mRNA levels were measured by quantitative real-time PCR. Human STAT3 primer probe set RTS199, as described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 60.

TABLE 60

Dose-dependent antisense inhibition of human STAT3 by free-uptake of ISIS oligonucleotide by SK-BR-3 cells

| ISIS No | 0.02 µM | 0.1 µM | 0.5 µM | 1 µM | 2.5 µM | 10 µM | $IC_{50}$ (µM) |
|---|---|---|---|---|---|---|---|
| 455265 | 22 | 14 | 25 | 19 | 30 | 37 | >10.0 |
| 455269 | 17 | 17 | 21 | 45 | 64 | 67 | 1.3 |
| 455271 | 0 | 0 | 0 | 11 | 16 | 53 | 9.0 |
| 455272 | 0 | 0 | 0 | 5 | 12 | 51 | 9.6 |
| 455291 | 9 | 15 | 31 | 45 | 58 | 76 | 1.2 |
| 455371 | 16 | 20 | 34 | 37 | 54 | 70 | 1.7 |
| 455394 | 0 | 2 | 14 | 6 | 30 | 55 | 8.3 |
| 455429 | 0 | 0 | 0 | 12 | 29 | 57 | 7.9 |
| 455471 | 0 | 16 | 28 | 24 | 42 | 58 | 2.9 |
| 455527 | 5 | 15 | 14 | 21 | 35 | 45 | >10.0 |
| 455530 | 0 | 14 | 12 | 14 | 28 | 36 | >10.0 |
| 455536 | 0 | 0 | 0 | 1 | 8 | 26 | >10.0 |
| 455548 | 16 | 14 | 17 | 17 | 20 | 44 | >10.0 |
| 455611 | 19 | 1 | 3 | 21 | 35 | 38 | >10.0 |
| 455703 | 0 | 0 | 0 | 0 | 3 | 33 | >10.0 |
| 465236 | 0 | 7 | 15 | 19 | 37 | 60 | 3.8 |
| 465237 | 2 | 13 | 22 | 29 | 50 | 67 | 2.3 |
| 465588 | 5 | 3 | 21 | 18 | 42 | 44 | >10.0 |
| 465740 | 1 | 14 | 0 | 19 | 14 | 39 | >10.0 |
| 465754 | 0 | 0 | 4 | 15 | 39 | 55 | 7.7 |
| 465830 | 6 | 18 | 23 | 17 | 42 | 67 | 3.0 |
| 466670 | 21 | 19 | 33 | 35 | 58 | 71 | 1.6 |
| 466720 | 0 | 0 | 11 | 13 | 27 | 53 | 8.7 |

Example 42

Measurement of Viscosity of Isis Antisense Oligonucleotides Targeting Human STAT3

The viscosity of antisense oligonucleotides selected from the studies described in Examples 6-10 was measured with the aim of screening out antisense oligonucleotides which have a viscosity more than 40 cP. Oligonucleotides having a viscosity greater than 40 cP would be too viscous to be administered to any subject.

ISIS oligonucleotides (32-35 mg) were weighed into a glass vial, 120 µl, of water was added and the antisense oligonucleotide was dissolved into solution by heating the vial at 50° C. Part of (75 µL) the pre-heated sample was pipetted to a micro-viscometer (Cambridge). The temperature of the micro-viscometter was set to 25° C. and the viscosity of the sample was measured. Another part (20 µL) of the pre-heated sample was pipetted into 10 mL of water for UV reading at 260 nM at 85° C. (Cary UV instrument). The results are presented in Table 61 and indicate that all the antisense oligonucleotides solutions are optimal in their viscosity under the criterion stated above.

TABLE 61

Viscosity of ISIS antisense oligonucleotides targeting human STAT3

| ISIS No | Viscosity |
|---|---|
| 455269 | 6.1 |
| 455291 | 13.6 |
| 466371 | 7.2 |
| 455703 | 17.6 |

TABLE 61-continued

Viscosity of ISIS antisense oligonucleotides targeting human STAT3

| ISIS No | Viscosity |
|---|---|
| 455429 | 9.3 |
| 465237 | 26.2 |
| 465754 | 19.7 |
| 465830 | 8.1 |
| 466670 | 15.9 |

Example 43

Effect of ISIS Antisense Oligonucleotides Targeting Human STAT3 in Cynomolgus Monkeys Nine antisense oligonucleotides exhibiting a high level of potency were further tested for in cynomolgus monkeys. Antisense oligonucleotide tolerability and pharmacokinetic profile in the liver and kidney was evaluated.

The study was conducted at the Korea Institute of Toxicology, Republic of Korea. Prior to the study, the monkeys were kept in quarantine for a 30-day time period, during which standard panels of serum chemistry and hematology, examination of fecal samples for ova and parasites, and a tuberculosis test, were conducted to screen out abnormal or ailing monkeys. Nine groups of four randomly assigned male cynomolgus monkeys each were injected subcutaneously thrice per week for the first week, and subsequently twice a week for the next 7 weeks, with 25 mg/kg of ISIS antisense oligonucleotides. A control group of 4 cynomolgus monkeys was injected with PBS subcutaneously thrice per week for the first week, and subsequently twice a week for the next 7 weeks. Terminal sacrifices of all groups were conducted on day 55, which was 48 hours after the last dose.

During the study period, the monkeys were observed daily for signs of illness or distress. Any animal showing adverse effects to the treatment was removed and referred to the veterinarian and Study Director.

To evaluate the effect of ISIS oligonucleotides on the overall health of the animals, spleen heart, kidney, liver, and gall bladder weights were measured at day 55. Organ weights were measured and treatment group weights were compared to the corresponding PBS control weights To evaluate the effect of ISIS oligonucleotides on hepatic and kidney function, blood samples were collected from all the study groups. The monkeys were fasted overnight prior to blood collection. Approximately, 1 mL each of blood samples was collected in tubes without any anticoagulant for serum separation. The tubes were kept at room temperature for 90 min and then centrifuged (3000 rpm for 10 min at room temperature) to obtain serum. Concentrations of transaminases were measured using a Toshiba 200FR NEO chemistry analyzer (Toshiba Co., Japan). Plasma concentrations of ALT (alanine transaminase), AST (aspartate transaminase), and BUN were measured on day 55. C-reactive protein (CRP), which is synthesized in the liver and which serves as a marker of inflammation, was also similarly measured on day 55.

To evaluate the effect of ISIS oligonucleotides on factors involved in inflammation, blood was collected on day 55 from all animals for analyses of complement C3 levels, MIP-1β cytokine levels, and platelet number.

For complement C3 analysis, approximately 0.5 mL each of blood sample was collected in tubes without anticoagulant for serum separation. For cytokine level analyses, approximately 2 mL each of blood sample was collected in tubes without anticoagulant for serum separation. The tubes were kept at room temperature for 90 min and then centrifuged (3000 rpm for 10 min at room temperature) to obtain serum. Complement C3 was measured using an automatic analyzer (Toshiba 200 FR NEO chemistry analyzer, Toshiba co., Japan). Serum was utilized for cytokine analysis using a nine-panel Searchlight Multiplex Array.

For platelet count, approximately 0.5 mL each of blood samples was collected in tubes containing potassium salt of EDTA. Samples were analyzed for platelet count using an ADVIA120 hematology analyzer (Bayer, USA).

The concentration of oligonucleotide was measured in the liver and kidney on day 55. The method used is a modification of previously published methods (Leeds et al., 1996; Geary et al., 1999), which includes a phenol-chloroform (liquid-liquid) extraction followed by a solid phase extraction. An internal standard (ISIS 355868, a 27-mer 2'-O-methoxyethyl modified phosphorothioate oligonucleotide, GCGTTTGCTCTTCTTCTTGCGTTTTTT, designated herein as SEQ ID NO: 2758) was added prior to extraction. Tissue sample concentrations were calculated using calibration curves, with a lower limit of quantitation (LLOQ) of approximately 1.14 µg/g.

Among the 9 antisense oligonucleotides tested, certain antisense oligonucleotides, including ISIS 455269, ISIS 455371, ISIS 455429, and ISIS 455670 met tolerability thresholds for organ weight, ALT, AST, BUN, and hematological parameters.

Example 44

Dose-Dependent Antisense Inhibition of STAT3 Following Free Uptake of Antisense Oligonucleotide in MDA-MB-231 Cells ISIS oligonucleotides from the study described in Example 12 were further tested at different doses in MDA-MB-231 cells. Cells were plated at a density of 4,000 cells per well. Cells were incubated without any transfection reagent with 0.02 µM, 0.20 µM, 1.00 µM, 5.00 µM, and 10.00 µM concentrations of antisense oligonucleotide, as specified in Table 62. After approximately 24 hours, RNA was isolated from the cells and STAT3 mRNA levels were measured by quantitative real-time PCR. Human STAT3 primer probe set RTS199, as described hereinabove, was used to measure mRNA levels. STAT3 mRNA levels were adjusted according to total RNA content, as measured by RIBOGREEN®. Results are presented as percent inhibition of STAT3, relative to untreated control cells. The half maximal inhibitory concentration ($IC_{50}$) of each oligonucleotide is also presented in Table 62.

TABLE 62

Dose-dependent antisense inhibition of STAT3 mRNA levels by free-uptake of ISIS oligonucleotide by MDA-MB-231 cells

| ISIS No | 0.02 µM | 0.20 µM | 1.00 µM | 5.00 µM | 10.00 µM | $IC_{50}$ (µM) |
|---|---|---|---|---|---|---|
| 455269 | 0 | 3 | 30 | 47 | 59 | 6.4 |
| 455291 | 1 | 3 | 13 | 41 | 47 | 8.3 |
| 455371 | 5 | 0 | 10 | 34 | 43 | >10.0 |
| 455429 | 0 | 0 | 22 | 31 | 43 | >10.0 |
| 455703 | 0 | 5 | 13 | 28 | 39 | >10.0 |
| 465237 | 0 | 0 | 22 | 39 | 41 | >10.0 |
| 465754 | 5 | 1 | 22 | 30 | 46 | >10.0 |
| 465830 | 0 | 0 | 17 | 43 | 52 | 7.5 |
| 466670 | 4 | 7 | 18 | 49 | 56 | 6.5 |

Example 45

Dose-Dependent Antisense Inhibition of STAT3 Following Free Uptake of Antisense Oligonucleotide in U251-MG Cells ISIS oligonucleotides from the study described in Example 12 were further tested at different doses in U251-MG cells. Cells were plated at a density of 4,000 cells per well. Cells were incubated without any transfection reagent with 0.1 µM, 1.0 µM, 5.0 µM, 10.0 µM, and 20.0 µM concentrations of antisense oligonucleotide, as specified in Table 63. After approximately 24 hours, RNA was isolated from the cells and STAT3 mRNA levels were measured by quantitative real-time PCR. Human STAT3 primer probe set RTS199, as described hereinabove, was used to measure mRNA levels. STAT3 mRNA levels were adjusted according to total RNA content, as measured by RIBOGREEN®. Results are presented as percent inhibition of STAT3, relative to untreated control cells. The half maximal inhibitory concentration ($IC_{50}$) of each oligonucleotide is also presented in Table 63.

TABLE 63

Dose-dependent antisense inhibition of STAT3 mRNA levels by free-uptake of ISIS oligonucleotide by U251-MG cells

| ISIS No | 0.1 µM | 1.0 µM | 5.0 µM | 10.0 µM | 20.0 µM | $IC_{50}$ (µM) |
|---|---|---|---|---|---|---|
| 455269 | 3 | 16 | 31 | 47 | 56 | 11.9 |
| 455291 | 0 | 11 | 29 | 42 | 51 | 14.1 |
| 455371 | 3 | 0 | 25 | 33 | 39 | >20.0 |
| 455429 | 6 | 0 | 25 | 33 | 39 | >20.0 |
| 455703 | 5 | 2 | 13 | 33 | 36 | >20.0 |
| 465237 | 2 | 0 | 7 | 2 | 6 | >20.0 |
| 465754 | 0 | 0 | 8 | 16 | 4 | >20.0 |
| 465830 | 0 | 0 | 18 | 2 | 10 | >20.0 |
| 466670 | 0 | 0 | 18 | 25 | 37 | >20.0 |

Example 46

Dose-Dependent Antisense Inhibition of STAT3 Following Free Uptake of Antisense Oligonucleotide in A431 Cells ISIS oligonucleotides from the study described in Example 12 were further tested at different doses in A431 cells. Cells were plated at a density of 4,000 cells per well. Cells were incubated without any transfection reagent with 0.02 µM, 0.2 µM, 1.0 µM, 5.0 µM, and 10.0 µM concentrations of antisense oligonucleotide, as specified in Table 64. After approximately 24 hours, RNA was isolated from the cells and STAT3 mRNA levels were measured by quantitative real-time PCR. Human STAT3 primer probe set RTS199, as described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 64. As illustrated in Table 64, the ISIS oligonucleotides were able to penetrate the cell membrane and significantly reduce STAT3 mRNA levels in a dose-dependent manner.

TABLE 64

Dose-dependent antisense inhibition of STAT3 mRNA levels by free-uptake of ISIS oligonucleotide by A431 cells

| ISIS No | 0.02 µM | 0.2 µM | 1.0 µM | 5.0 µM | 10.0 µM | $IC_{50}$ (µM) |
|---|---|---|---|---|---|---|
| 455269 | 41 | 64 | 86 | 86 | 89 | 0.15 |
| 455291 | 25 | 61 | 83 | 85 | 86 | 0.17 |
| 455371 | 30 | 65 | 82 | 88 | 92 | 0.15 |
| 455429 | 15 | 73 | 84 | 87 | 88 | 0.19 |
| 455703 | 12 | 55 | 72 | 82 | 82 | 0.13 |
| 465237 | 23 | 72 | 82 | 86 | 87 | 0.13 |
| 465754 | 0 | 67 | 73 | 79 | 83 | 0.15 |
| 465830 | 0 | 50 | 67 | 71 | 78 | 0.21 |
| 466670 | 36 | 79 | 88 | 93 | 94 | 0.03 |

Example 47

Dose-Dependent Antisense Inhibition of STAT3 Following Free Uptake of Antisense Oligonucleotide in H460 Cells ISIS oligonucleotides from the study described in Example 12 were further tested at different doses in H460 cells. Cells were plated at a density of 4,000 cells per well. Cells were incubated without any transfection reagent with 0.02 µM, 0.20 µM, 1.00 µM, 5.00 µM, and 10.00 µM concentrations of antisense oligonucleotide, as specified in Table 65. After approximately 24 hours, RNA was isolated from the cells and STAT3 mRNA levels were measured by quantitative real-time PCR. Human STAT3 primer probe set RTS199, as described hereinabove, was used to measure mRNA levels. STAT3 mRNA levels were adjusted according to total RNA content, as measured by RIBOGREEN®. Results are presented as percent inhibition of STAT3, relative to untreated control cells.

The half maximal inhibitory concentration ($IC_{50}$) of each oligonucleotide is also presented in Table 65. As illustrated in Table 65, the ISIS oligonucleotides were able to penetrate the cell membrane and significantly reduce STAT3 mRNA levels in a dose-dependent manner.

TABLE 65

Dose-dependent antisense inhibition of STAT3 mRNA levels by free-uptake of ISIS oligonucleotide by H460 cells

| ISIS No | 0.02 µM | 0.20 µM | 1.00 µM | 5.00 µM | 10.00 µM | $IC_{50}$ (µM) |
|---|---|---|---|---|---|---|
| 455269 | 3 | 69 | 81 | 92 | 94 | 0.1 |
| 455291 | 0 | 29 | 79 | 88 | 92 | 0.3 |
| 455371 | 0 | 20 | 63 | 85 | 89 | 0.8 |
| 455429 | 3 | 37 | 75 | 87 | 88 | 0.6 |
| 455703 | 4 | 24 | 69 | 87 | 92 | 0.3 |
| 465237 | 0 | 20 | 72 | 87 | 89 | 0.6 |
| 465754 | 10 | 45 | 80 | 91 | 92 | 0.2 |
| 465830 | 10 | 28 | 65 | 82 | 89 | 0.7 |
| 466670 | 15 | 32 | 71 | 90 | 93 | 0.3 |

Example 48

Effect of ISIS Oligonucleotides Targeting STAT3 in the Treatment of U251 Human Glioma Cancer Xenograft Model BALB/c nude mice inoculated with human U251 glioma tumor cells were treated with ISIS oligonucleotides from the study described in Example 12. The effect of the treatment on tumor growth in the mice was evaluated.

Treatment

BALB/c nude mice were subcutaneously implanted with 1×10$^6$ tumor cells. On day 4 of the implantation, groups of 4 mice each were administered 50 mg/kg injected intraperitoneally five times a week for 3 and a half weeks of ISIS 455269, ISIS 455291, ISIS 455371, ISIS 455703, ISIS 455429, ISIS 465237, ISIS 465754, ISIS 465830, or ISIS 466670. One group of mice was administered 50 mg/kg injected intraperitoneally five times a week for 3 and a half weeks of the control oligonucleotide, ISIS141923. One group of mice was administered PBS injected intraperitoneally five times a week for 3 and a half weeks.

Effect on Tumor Growth

Tumor size was measured twice weekly in two dimensions using a caliper, and tumor volumes were calculated using the formula: V=0.5×a×b$^2$, where a and b are the long and short diameters of the tumor, respectively. The results are presented in Table 66. The data indicates that treatment with ISIS oligonucleotides significantly impeded tumor growth. 'n/a' indicates that the data points for that time point are not available.

TABLE 66

Effect of antisense inhibition of STAT3 on tumor growth in the U251 xenograft model

| | Day 10 | Day 14 | Day 17 | Day 21 | Day 23 | Day 29 | Day 32 | Day 35 |
|---|---|---|---|---|---|---|---|---|
| PBS | 205 | 216 | 285 | 381 | 519 | 771 | 937 | 1,141 |
| ISIS 141923 | 175 | 178 | 296 | 404 | 544 | 719 | 923 | 1,027 |
| ISIS 455269 | 157 | 151 | 227 | 307 | 349 | 418 | 486 | 542 |
| ISIS 455291 | 149 | 169 | 193 | 238 | 297 | 429 | 635 | 610 |
| ISIS 455371 | 141 | 169 | 253 | 379 | 375 | 598 | 838 | 912 |
| ISIS 455429 | 180 | 160 | 251 | 337 | 427 | 546 | 807 | 897 |
| ISIS 455703 | 156 | 161 | 246 | 342 | 414 | 615 | 872 | 991 |
| ISIS 465237 | 149 | 166 | 245 | 326 | 350 | 551 | 703 | 744 |
| ISIS 465830 | 173 | 205 | 287 | 346 | 383 | 696 | 844 | 825 |
| ISIS 466670 | 112 | 172 | 208 | 254 | 274 | 492 | 462 | 669 |

Example 49

Effect of ISIS 455291 Targeting STAT3 in the Treatment of an MDA-MB-231 Human Breast Cancer Xenograft Model BALB/c nude mice inoculated with human breast cancer cells MDA-MB-231 were treated with ISIS 455291. The effect of the treatment on tumor growth and tolerability in the mice was evaluated.

Treatment

The study was conducted at Pharmaron Inc (Beijing, P.R. China). The BALB/c nude mice were obtained from Beijing HFK Bio-Technology Co., Ltd. MDA-MB-231 human breast cancer cells were maintained in vitro as a monolayer culture in Leibovitz's L-15 medium supplemented with 10% heat-inactivated fetal calf serum, 100 U/mL penicillin, 100 µg/mL streptomycin, and 2 mM L-glutamine. The cells were maintained at 37° C. in an atmosphere of 5% CO$_2$ in air. The tumor cells were routinely sub-cultured twice weekly with trypsin-EDTA treatment. Cells growing an exponential growth phase were harvested and counted for tumor inoculation.

Two groups of eight randomly assigned 6-8 week-old female BALB/c nude mice each were inoculated at the right flank with the MDA-MB-231 tumor fragments (3 mm×2 mm×2 mm, which were generated from tumor inoculation passage) for tumor development. Antisense oligonucleotide treatment started at day 11 after tumor inoculation when the mean tumor size reached approximately 100 mm$^3$. One of the groups was injected intraperitoneally twice a week for 3 weeks with 50 mg/kg of ISIS 455291. The other group of mice was injected intraperitoneally twice a week for 3 weeks with PBS, and served as the control group.

All procedures related to animal handling, care, and treatment, were performed according to the guidelines approved by the Institutional Animal Care and Use Committee (IACUC). At the time of routine monitoring, the animals were checked for any effects of tumor growth on normal behavior, such as mobility, food consumption, body weight changes and any other abnormal effect.

RNA Analysis

RNA was extracted from tumor tissue for real-time PCR analysis of human STAT3 mRNA levels using primer probe set RTS199, described hereinabove. Murine STAT3 mRNA levels were also measured using primer probe set mSTAT3_LTS00664 (forward sequence CGACAGCTTC-CCCATGGA, designated herein as SEQ ID NO: 1513; reverse sequence ATGCCCAGTCTTGACTCTCAATC, designated herein as SEQ ID NO: 1514; probe sequence CTGCGGCAGTTCCTGGCACCTT, designated herein as SEQ ID NO: 1515). Results are presented as percent inhibition of STAT3, relative to PBS control, normalized to cyclophilin. As shown in Table 67, treatment with ISIS 455291 resulted in reduction of both human and murine STAT3 mRNA in comparison to the PBS control.

TABLE 67

Inhibition of STAT3 mRNA in the treatment groups relative to the PBS control in the MDA-MB-231 xenograft model

| | % inhibition |
|---|---|
| Human STAT3 | 91 |
| Murine STAT3 | 94 |

Effect on Tumor Growth

Tumor size was measured twice weekly in two dimensions using a caliper, and tumor volumes were calculated using the formula: V=0.536×a×b$^2$, where a and b are the long and short diameters of the tumor, respectively. The tumor size was utilized for calculations of the T-C and T$_V$/C$_V$ values. T-C was calculated with T as the median time (in days) required for the tumors in the treatment groups to reach a pre-determined size (900 mm$^3$), and C as the median time (in days) for the tumors in the control group to reach the same size. The T$_V$/C$_V$ value (expressed as percentage) is an indication of the anti-tumor effectiveness of the ISIS oligonucleotides, where T$_V$ and C$_V$ were the mean volume of the treated and control groups, respectively, on a given day (day 32).

The results are presented in Tables 68 and 69. The data indicates that inhibition of STAT3 mRNA significantly impeded tumor growth.

TABLE 68

Effect of antisense inhibition of STAT3 on tumor growth in the MDA-MB-231 xenograft model

| Days | PBS | ISIS 455291 |
|---|---|---|
| 11 | 103 | 103 |
| 15 | 185 | 156 |
| 18 | 292 | 205 |
| 22 | 519 | 320 |
| 25 | 745 | 437 |

TABLE 68-continued

Effect of antisense inhibition of STAT3 on tumor growth in the MDA-MB-231 xenograft model

| Days | PBS | ISIS 455291 |
|---|---|---|
| 29 | 1,332 | 792 |
| 32 | 1,741 | 1,075 |

TABLE 69

Effect of antisense inhibition of STAT3 on tumor growth inhibition in the MDA-MB-231 xenograft model

| Treatment | Tumor Size (mm³) at day 32 | $T_V/C_V$ (%) | T-C at 900 mm³ |
|---|---|---|---|
| PBS | 1,741 | — | — |
| ISIS 455291 | 1,075 | 62 | 4 |

Body Weight Measurements

To evaluate the effect of ISIS oligonucleotides on the overall health of the animals, body weights were measured on a regular basis during the treatment period. The data is presented in Table 70 and indicate that treatment with ISIS 455291 does not affect the overall body weight of the mice.

TABLE 70

Body weight measurements of mice in the MDA-MB-231 xenograft model

| | Day 11 | Day 15 | Day 18 | Day 22 | Day 25 | Day 29 | Day 32 |
|---|---|---|---|---|---|---|---|
| PBS | 22 | 22 | 23 | 23 | 23 | 23 | 24 |
| ISIS 455291 | 22 | 22 | 23 | 23 | 24 | 24 | 25 |

Example 50

Effect of ISIS 455291 Targeting STAT3 in the Treatment of an A431 Human Epidermoid Carcinoma Xenograft Model BALB/c nude mice inoculated with human epidermoid cancer cells A431 were treated with ISIS 455291. The effect of the treatment on tumor growth and tolerability in the mice was evaluated.

Treatment

The study was conducted at Pharmaron Inc (Beijing, P.R. China). The BALB/c nude mice were obtained from Beijing HFK Bio-Technology Co., Ltd. A431 human epidermoid carcinoma cells were maintained in vitro as a monolayer culture in DMEM medium supplemented with 10% heat-inactivated fetal calf serum, 100 U/mL penicillin, 100 µg/mL streptomycin, and 2 mM L-glutamine. The cells were maintained at 37° C. in an atmosphere of 5% $CO_2$ in air. The tumor cells were routinely sub-cultured twice weekly with trypsin-EDTA treatment. Cells growing in an exponential growth phase were harvested and counted for tumor inoculation.

Two groups of eight randomly assigned 6-8 week-old female BALB/c nude mice each were inoculated subcutaneously with $5\times10^6$ A431 tumor cells for tumor development. Antisense oligonucleotide treatment started at day 8 after tumor inoculation when the mean tumor size reached approximately 95 mm³. One of the groups was injected intraperitoneally twice a week for 4 weeks with 50 mg/kg of ISIS 455291. The other group of mice was injected intraperitoneally twice a week for 3 weeks with PBS, and served as the control group.

All procedures related to animal handling, care, and treatment, were performed according to the guidelines approved by the Institutional Animal Care and Use Committee (IACUC). At the time of routine monitoring, the animals were checked for any effects of tumor growth on normal behavior, such as mobility, food consumption, body weight changes and any other abnormal effect.

RNA Analysis

RNA was extracted from tumor tissue for real-time PCR analysis of human STAT3 mRNA levels using primer probe set RTS199, described hereinabove. Murine STAT3 mRNA levels were also measured using primer probe set mSTAT3_LTS00664. Results are presented as percent inhibition of STAT3, relative to PBS control, normalized to cyclophilin. As shown in Table 71, treatment with ISIS 455291 resulted in reduction of both human and murine STAT3 mRNA in comparison to the PBS control.

TABLE 71

Inhibition of STAT3 mRNA in the treatment groups relative to the PBS control in the A431 xenograft model

| | % inhibition |
|---|---|
| Human STAT3 | 67 |
| Murine STAT3 | 92 |

Effect on Tumor Growth

Tumor size was measured twice weekly in two dimensions using a caliper, and tumor volumes were calculated using the formula: $V=0.5\times a\times b^2$, where a and b are the long and short diameters of the tumor, respectively. The tumor size was utilized for calculations of the T-C and $T_V/C_V$ values. T-C was calculated with T as the median time (in days) required for the tumors in the treatment groups to reach a pre-determined size (800 mm³), and C as the median time (in days) for the tumors in the control group to reach the same size. The $T_V/C_V$ value (expressed as percentage) is an indication of the anti-tumor effectiveness of the ISIS oligonucleotides, where $T_V$ and $C_V$ were the mean volume of the treated and control groups, respectively, on a given day (day 33).

The results are presented in Tables 72 and 73. The data indicates that inhibition of STAT3 mRNA impeded tumor growth.

TABLE 72

Effect of antisense inhibition of STAT3 on tumor growth in the A431 xenograft model

| Days | PBS | ISIS 455291 |
|---|---|---|
| 8 | 94 | 95 |
| 14 | 178 | 173 |
| 17 | 308 | 242 |
| 21 | 528 | 393 |
| 24 | 682 | 572 |
| 28 | 875 | 759 |
| 31 | 1,071 | 984 |
| 33 | 1,210 | 1,112 |

TABLE 73

Effect of antisense inhibition of STATS on tumor growth inhibition in the A431 xenograft model

| Treatment | Tumor Size (mm³) at day 33 | $T_V/C_V$ (%) | T-C at 800 mm³ |
|---|---|---|---|
| PBS | 1,210 | — | — |
| ISIS 455291 | 1,112 | 92 | 2 |

Body Weight Measurements

To evaluate the effect of ISIS oligonucleotides on the overall health of the animals, body weights were measured on a regular basis during the treatment period. The data is presented in Table 74 and indicate that treatment with ISIS 455291 does not affect the overall body weight of the mice.

TABLE 74

Body weight measurements of mice in the A431 xenograft model

| | Day 8 | Day 14 | Day 17 | Day 21 | Day 24 | Day 28 | Day 31 | Day 33 |
|---|---|---|---|---|---|---|---|---|
| PBS | 20 | 20 | 20 | 21 | 21 | 21 | 22 | 22 |
| ISIS 455291 | 20 | 21 | 21 | 22 | 22 | 22 | 23 | 23 |

Example 51

Effect of ISIS 455291 Targeting STAT3 in the Treatment of an NCI-H460 Human Non-Small Cell Lung Cancer (NSCLC) Xenograft Model BALB/c nude mice inoculated with human NCI-H460 human NSCLC were treated with ISIS 455291. The effect of the treatment on tumor growth and tolerability in the mice was evaluated.

Treatment

The study was conducted at Pharmaron Inc (Beijing, P.R. China). The BALB/c nude mice were obtained from Beijing HFK Bio-Technology Co., Ltd. NCI-H460 human NSCLC cells were maintained in vitro as a monolayer culture in RPMI-1640 medium supplemented with 10% heat-inactivated fetal calf serum, 100 U/mL penicillin, 100 µg/mL streptomycin, and 2 mM L-glutamine. The cells were maintained at 37° C. in an atmosphere of 5% $CO_2$ in air. The tumor cells were routinely sub-cultured twice weekly with trypsin-EDTA treatment. Cells growing in an exponential growth phase were harvested and counted for tumor inoculation.

Two groups of eight randomly assigned 6-8 week-old female BALB/c nude mice each were inoculated subcutaneously with $2 \times 10^6$ NCI-H460 tumor cells for tumor development. Antisense oligonucleotide treatment started at day 6 after tumor inoculation when the mean tumor size reached approximately 100 mm³. One of the groups was injected intraperitoneally twice a week for 3 weeks with 50 mg/kg of ISIS 455291. The other group of mice was injected intraperitoneally twice a week for 3 weeks with PBS, and served as the control group.

All procedures related to animal handling, care, and treatment, were performed according to the guidelines approved by the Institutional Animal Care and Use Committee (IACUC). At the time of routine monitoring, the animals were checked for any effects of tumor growth on normal behavior, such as mobility, food consumption, body weight changes and any other abnormal effect.

Effect on Tumor Growth

Tumor size was measured twice weekly in two dimensions using a caliper, and tumor volumes were calculated using the formula: $V = 0.5 \times a \times b^2$, where a and b are the long and short diameters of the tumor, respectively. The tumor size was utilized for calculations of the T-C and $T_V/C_V$ values. T-C was calculated with T as the median time (in days) required for the tumors in the treatment groups to reach a pre-determined size (1,500 mm³), and C as the median time (in days) for the tumors in the control group to reach the same size. The $T_V/C_V$ value (expressed as percentage) is an indication of the anti-tumor effectiveness of the ISIS oligonucleotides, where $T_V$ and $C_V$ were the mean volume of the treated and control groups, respectively, on a given day (day 20).

The results are presented in Tables 75 and 76. The data indicates that inhibition of STAT3 significantly impeded tumor growth.

TABLE 75

Effect of antisense inhibition of STAT3 on tumor growth in the NCI-H460 xenograft model

| Days | PBS | ISIS 455291 |
|---|---|---|
| 6 | 104 | 104 |
| 8 | 303 | 180 |
| 11 | 746 | 408 |
| 13 | 1,175 | 620 |
| 15 | 1,642 | 819 |
| 18 | 2,277 | 1,320 |
| 20 | 2,859 | 1,812 |
| 22 | — | 2,330 |

TABLE 76

Effect of antisense inhibition of STAT3 on tumor growth inhibition in the NCI-H460 xenograft model

| Treatment | Tumor Size (mm³) at day 20 | $T_V/C_V$ (%) | T-C at 800 mm³ |
|---|---|---|---|
| PBS | 1,210 | — | — |
| ISIS 455291 | 1,812 | 63 | 4 |

Body Weight Measurements

To evaluate the effect of ISIS oligonucleotides on the overall health of the animals, body weights were measured on a regular basis during the treatment period. The data is presented in Table 77 and indicate that treatment with ISIS 455291 does not affect the overall body weight of the mice.

TABLE 77

Body weight measurements of mice in the NCI-H460 xenograft model

| | Day 6 | Day 8 | Day 11 | Day 13 | Day 15 | Day 18 | Day 20 | Day 22 |
|---|---|---|---|---|---|---|---|---|
| PBS | 20 | 20 | 20 | 20 | 20 | 20 | 21 | — |
| ISIS 455291 | 20 | 20 | 20 | 20 | 20 | 19 | 20 | 20 |

Example 52

Effect of Antisense Inhibition of Human STAT3 in a Human Glioblastoma Orthotopic Mouse Model NU/J mice orthotopically implanted with human glioblastoma cells were treated with ISIS 455291, a 5-10-5 MOE gapmer having a sequence of CAGCAGATCAAGTC-CAGGGA (SEQ ID NO: 1590). The effect of the treatment on tumor growth and tolerability in the mice was evaluated.

Treatment

Thirty NU/J mice were stereotactically implanted in the right frontal lobe with 5×10⁵ U-87 MG-luc2 cells. On day 15 after tumor cell implantation, 15 of these mice were dosed intracranially with a bolus injection at the site of tumor implantation with 100 µg of ISIS 455291, which was dissolved in 2 µL of PBS. The remaining 15 mice were dosed intracranially with a bolus injection at the site of tumor implantation with 2 µL of PBS. The second group of mice served as the control group.

Analysis

On day 18 after tumor transplantation, five mice from each group were euthanized by $CO_2$ inhalation and brain samples were collected for RNA analysis. RNA was extracted from tumor tissue for real-time PCR analysis of human STAT3 mRNA levels using primer probe set RTS199, described hereinabove. Treatment with ISIS 455291 resulted in 27% reduction of human STAT3 mRNA in the tumor tissue in comparison to the PBS control.

The remaining mice in each group were monitored regularly up to 2 weeks for survival analysis. The median survival for the PBS control group was 30.5 days. The medial survival for the ISIS oligonucleotide-treated mice was 35 days. The P value was 0.2088.

Example 53

Dose-Dependent Antisense Inhibition of STAT3 Following Free Uptake of Antisense Oligonucleotide in PC9 Cells ISIS 455703 and ISIS 455291, from the studies described above, were further tested at different doses in PC9 cells, a non small cell lung carcinoma cell line. Cells were plated at a density of 3,000 cells per well. Cells were incubated with 0.02 µM, 0.1 µM, 0.5 µM, 2.5 µM, and 10.0 µM concentrations of antisense oligonucleotide, as specified in Table 78. After approximately 24 hours, RNA was isolated from the cells and STAT3 mRNA levels were measured by quantitative real-time PCR. Human STAT3 primer probe set RTS2033 (forward sequence GAGGCCCGCCCAACA, designated herein as SEQ ID NO: 1520; reverse sequence TTCTGCTAATGACGTTATCCAGMT, designated herein as SEQ ID NO: 1521; probe sequence CTGCCTAGATCGGC, designated herein as SEQ ID NO: 1522) was used to measure mRNA levels. STAT3 mRNA levels were adjusted according to content of beta-actin, a housekeeping gene, as measured by human primer probe set HTS5002 (forward sequence CGGACTATGACTTAGTTGCGTTACA, designated herein as SEQ ID NO: 1529; reverse sequence GCCATGCCAATCTCATCTTGT, designated herein as SEQ ID NO: 1530; probe sequence CCTTTCTTGACAAAACCTAACTTGCGCAGA, designated herein as SEQ ID NO: 1531). Results are presented as percent inhibition of STAT3, relative to untreated control cells.

The half maximal inhibitory concentration ($IC_{50}$) of each oligonucleotide is also presented in Table 78. As illustrated in Table 78, ISIS 455703 and ISIS 45529 lwere able to penetrate the cell membrane.

TABLE 78

Dose-dependent antisense inhibition of STAT3 mRNA levels by free-uptake of ISIS oligonucleotide by PC9 cells

| ISIS No | 0.02 µM | 0.1 µm | 0.5 µM | 2.5 µM | 10.0 µM | $IC_{50}$ (µM) |
|---|---|---|---|---|---|---|
| 455703 | 6 | 5 | 17 | 50 | 49 | 9.0 |
| 455291 | 0 | 0 | 42 | 67 | 75 | 1.2 |

Example 54

Dose-Dependent Antisense Inhibition of STAT3 Following Free Uptake of Antisense Oligonucleotide in C42B Cells ISIS 455291, from the studies described above, was further tested at different doses in C42B cells, a prostate cancer cell line. Cells were plated at a density of 3,000 cells per well. Cells were incubated with 0.02 µM, 0.1 µM, 0.5 µM, 2.5 µM, and 10.0 µM concentrations of antisense oligonucleotide, as specified in Table 79. After approximately 24 hours, RNA was isolated from the cells and STAT3 mRNA levels were measured by quantitative real-time PCR. Human STAT3 primer probe set RTS2033 (forward sequence GAGGCCCGCCCAACA, designated herein as SEQ ID NO: 1520; reverse sequence TTCTGCTAATGACGTTATCCAGTTTT, designated herein as SEQ ID NO: 1521; probe sequence CTGCCTAGATCGGC, designated herein as SEQ ID NO: 1522) was used to measure mRNA levels. STAT3 mRNA levels were adjusted according to content of beta-actin, a housekeeping gene, as measured by human primer probe set HTS5002 (forward sequence CGGACTATGACTTAGT-TGCGTTACA, designated herein as SEQ ID NO: 1529; reverse sequence GCCATGCCAATCTCATCTTGT, designated herein as SEQ ID NO: 1530; probe sequence CCTTTCTTGACAAAACCTAACTTGCGCAGA, designated herein as SEQ ID NO: 1531). Results are presented as percent inhibition of STAT3, relative to untreated control cells.

As illustrated in Table 79, ISIS 455291 was able to penetrate the cell membrane.

TABLE 79

Dose-dependent antisense inhibition of STAT3 mRNA levels by free-uptake of ISIS oligonucleotide by C42B cells

| ISIS No | 0.02 µM | 0.1 µM | 0.5 µM | 2.5 µM | 10.0 µM |
|---|---|---|---|---|---|
| 455291 | 0 | 0 | 17 | 10 | 41 |

Example 55

Dose-Dependent Antisense Inhibition of STAT3 Following Free Uptake of Antisense Oligonucleotide in Colo201 Cells ISIS 455291, from the studies described above, was further tested at different doses in Colo201 cells, a colorectal cancer cell line. Cells were plated at a density of 3,000 cells per well. Cells were incubated with 0.02 µM, 0.1 µM, 0.5 µM, 2.5 µM, and 10.0 µM concentrations of antisense oligonucleotide, as specified in Table 80. After approximately 24 hours, RNA was isolated from the cells and STAT3 mRNA levels were measured by quantitative real-time PCR. Human STAT3 primer probe set RTS2033 (forward sequence GAGGC-CCGCCCAACA, designated herein as SEQ ID NO: 1520; reverse sequence TTCTGCTAATGACGTTATCCAGTITT, designated herein as SEQ ID NO: 1521; probe sequence CTGCCTAGATCGGC, designated herein as SEQ ID NO: 1522) was used to measure mRNA levels. STAT3 mRNA levels were adjusted according to content of beta-actin, a housekeeping gene, as measured by human primer probe set HTS5002 (forward sequence CGGACTATGACTTAGT-TGCGTTACA, designated herein as SEQ ID NO: 1529; reverse sequence GCCATGCCAATCTCATCTTGT, designated herein as SEQ ID NO: 1530; probe sequence CCTTTCTTGACAAAACCTAACTTGCGCAGA, designated herein as SEQ ID NO: 1531). Results are presented as percent inhibition of STAT3, relative to untreated control cells.

The half maximal inhibitory concentration ($IC_{50}$) of each oligonucleotide is also presented in Table 80. As illustrated in Table 29, ISIS 455291 was able to penetrate the cell membrane.

TABLE 80

Dose-dependent antisense inhibition of STAT3 mRNA levels by free-uptake of ISIS oligonucleotide by Colo201 cells

| ISIS No | 0.02 µM | 0.1 µM | 0.5 µM | 2.5 µM | 10.0 µM | $IC_{50}$ (µM) |
| --- | --- | --- | --- | --- | --- | --- |
| 455291 | 21 | 18 | 34 | 52 | 81 | 1.2 |

SEQUENCE LISTING (2758 sequences)

SEQ ID NO: 1 - DNA, 4978 bp, Homo sapien
ggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtaaaaa

SEQ ID NO: 2 - DNA, 79001 bp, Homo sapien
ataaaaattaaaaaccctgatagtatcagcacatacacagaaatcactccattatgcaaagttcatcctctattatgaaaggcaaaatgtctacatttcctatcaaccactggcttcaattcagtaaaacttgcataccaagtaggcaaggtggaaaagaaaaaggcagaacatttcatgtatttcaattcagacgcataaaaatgtcaagccctacacgttatcagctttcgtatacaccgtcttctgcattcgcctgtacgggccaatgggctagctggtcggcgtttgatgcttgaagtgatggaacggagtacggggttaaatccactaccctctccccacgcactctagtaattactctatttccacgtcatgtttccgggtgtgtgtgtccctgctcacgcagaaactgaagttcaaagcaggcggagtcacccatgttctttttgttgtccccagaacccaattcaggagttgggtccccagaggatctggagatacctggggactatctaactagctgattcccgcgtggtaagaggctctcaacctcgccaccacgtggtgccaagggccgggaaaagggagagcgggcaggagggagctgtatcaggggcatttaaagtgccttgacgtcacgcactgccaggaactcagctgagttttcagcaggacattccggtcatcttccctccctccccccgggcttctgtgcccaagtcctcggctcttccctcgctgtggcggagggaggagcaccgaactgtcggaacagccagcacaggggcgtatcagtctcctcttggctccgccctttctcctagctgctctcctcattggtcagtgggcggggcttcggctgtaccgcacacgcactgggacctctgggtggccgaacgagctggcctttcatgaattatgcatgacggcgtgcctcggccaggctggggctgggcgaggattggctgaaggggctgtaattcagcggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggtgaagggggtgcagggtggggccgttggggaggcctggggacccgggggctccgcagcggcagggggcctctgggaccttggggatgttgtgatggacgctgcagtggggccgggagagatgaagagacgcggagggtcgccctgagggaagactcttcgggatgacaggagcgggcctcggaagggactcggggcgctggagggaagtttcgttcttcggagaaacagaacgcgctcgagggggcaccgtggggcgagggcgcactcggttgcggcggcaggagtgagggacagtcccccgatttcctgctccctggggccctggggacgttccggccaccggagcgactgtcacgccgacggggatcaccggcgcgagtggggggtcggaaagcgcctcctccccgcccggtcggcggctcccgctgagccacttcctccgcttgccctgttcccgctccttcaggagacagctgtgcccttttggaggcaggaataggtgtgtctgtcgcctgcagccttacgggctggctggtcgtgggtaggctttattgcataagaatcaagtttcctgtagggaaattgacagaccggtactctttctaaattccctcgcatctttttctaggttaaattatgctccccccacgtccccgccttgtaaaaaagagaaaaaaagacaaaataaaatccccatcaacccgtcaagccagctctagagagagaaataaacctcttgacattgtccttttccaaatacctggtaaagtcggccagaagataaataattgagccattgcatttactggattgtggtgttgcttaattgcataggacggaatgaaccaattgagagtgggagttttctgtctcagagccaagatcttgggtaaatgcagaggagagggaaacaaagacaggctggccttgaaaaaaccatgtgtgcaaactttacatgcatttggggggtgtggttgcactgaagttaacaagattcaaaccgtcgcccaagttggtatttccatgtttggtacacatcactctgtgccatatcaggtcgttgttaagtgtggtgacaaaatcagtggttagtcatttttttaattaaaaatgtgtatagtgtgtacctgctggtcttactgtatgtgcaactaaaggtttacatagtctgtgtatgggttgtaaatttttggctggctgtgctgataaagcattgggcttgaataaagcaaagcagaaaatcatctcaatcttttatatgtggatttagactgtgttatgacttggttcagccagttttctatcttattttatattaaatatgtctgtgttctctgagtcagcacatttatttccttattacatgttccagacaggagtgctagcccagtttttgttcagtttgcacagtgggatggggaaacaagtctggaatttaaaaaaaaatgttttagaggttggagccttgattttagtctctatattagcacatccatcacaaagaaccattagtaaattcatgaatcttttgttttttatgtagttcatttgagaagaataatcacttagaaatatccacagtgccaggcatggtggtgcacacctctgatcccagctaattgaaggctgaggtgggaggattccttgagtccaggagttgagtctggtctgggcaacatggtgagaggccaggaattgggtctagagtctagtctaagcaccataatgagaacccatctttaagaaagaaagaaaggaaaggaggaagaaaggaaagaaaaagaaatacccacagcacagttatgaattaacccacaaaggacttgtgaggtgggtagttcacataacaattaccctaatatcgtagataagaaaattgaggccaaaggatcaagacacttggccaacgcagcagagtgccatagtggtggaatttgtgcctccttctgtatattttgtgaaaagtatcagtgaaattctttttttttttttttttgagtcagagtcttgctctgttgcccaggctagagtgcagtggcgcaatcttggctcactgcaacctctgcctcctgggttcaagcgattctcctgcctcagcctcccaagtagctgggactacaggcgtgcgccaccacgcccagctaatttttgtatttttagtagagaccggggttttaccatattggccaggctggtcttgaactcctgaccttgtgatttgcccacctctatctcccaaagtgctgggattacaggtgtgagccaccgcgcccagtaagtatcagtgaaattctaacatatatctgaacagtaaaataccaccaataggctgaaagacttcatgggaggtaaatattcaataaacaggtgaaaaaagaaatacaaatggagcttgcttagattatttttctaattgctatgtctaacttgggaagtgaggaactgtttttggtcagcataatttaccatcagaatttagctatttactaatgaaaagaaatactaatctaggtttgttttagattaaggacagtcatgacctaaatgtcatttaaaccagagtgcattgtggcttgatcagtggtcatttctgtctctagaaagttgctttaacttctctgcctctacgtgtctcttgacattcagatatgaggtggggtagaggtggtgaccaactttccagacgcctgagtccaaaccttcttagcttatggttttcttaggtgatgtgcaaatcaacaaatatatacttttttttttttttttttgagttggagttgcactctatcacccaggctggagtgcagtggcatgatcgtggctcactgcaacctcctcctcccgggttcaagtgattctcgcacctcagcctcctgagtagctgggattacaggtgcccgccactacgcccggctaatttttgtatttttagtagagataaggtttcactatattgaccaggctggtctcaaactcctgacctcaagagatctgcccacctcagcctcccaaagtgctgggattacaggcgtgaaccaccttgcctggccaacatatatataccttttgcaactttgtcagagttgctatgaagaataagttgtatcttgttcacagaaattgcagtctactgggggagctgataaatgttttaaccatccaatgtaacatgttgtcatcaaagagatggtgagactttacacttgtgctaacaaggtagctgttctacataaaagaacatacagtacagatgtagaacttttctgttatcatagaacgttctattggacagtgctaggctgaatgctacagatcttcagagaaaggagaggttatgaggcctggagttgtctagaaagtctttttgccaaagagggatttcaactgggtcccaaataatgggtggaatttgataggtgtaaagaatttgcggtggtttatgcctgtaatcccagcactttgggaggctgaggcaggaggattgcttgagcccaggagtttgagaccagcttgggcaacgtggtaaaactccctctcccctaaaaataaaaaaaattagccaggcctggtggcgtggacctgtagtcccagctactggtgagactaaggtgggaggatcacccaagccccgggggttaaggctgcagtgagccgtgatcccgccaccgcactccagcctgggtgacagagtgagaccctgtctccaaaaaaaaaaaaaattcctggtagcccggtagactaggagggtaagtaggggagaagtgattacttacaaaagacattgaatacaggaccaaggaatttcagttctgttcttttgtaggggaagcttttaaaactttcggggcgccgggcgcggtggctcacgcctgtaatcccagcactttgggaggcccagacgcgcggatcacgaggccaggagatcgagaccatcctggctaacacggtgaaaccccatctctactaaaaatacaaaaaaaagtagccgggcgttgtggcgggcgtctgtagtcccagctactcgggaggctgaggcaggagaagagcgtgaactcgggaggcggagcttgcagtgagccgatatcgcaccactgcactccagcctgggcgacagagcgagactccgtctcaaaaaaaaaaaaaataaataaataaataaataaataaaactttggagccgaagcactgatgtttaatcatagagtgcttactatgtgttaggcacaggcctgattgcctgatgctggttaatttgtacaaagtaaatcagtgcatatgccctctgccctaggggagttattaactggagtctgacattgtacaaaggtaggtatcctgactagtttgatttggtactttgggtgaaaaaagtatagtgtgcttaagtgcagaagtgttttttgaggatttttgattggatacaaaccaccactcatattttatgtctttggcacttaaaaatttcaccataacttttgagtcatttataaaaaccactgaaagagtacttgagggacatccccgaatcctgaagaacttctggtgttctggagcagcctcagtgagatccaggaggatggcattgctgggctggcccagcccttattgattatggtgtaaagaattaatatggtggttatatactctttgttagacaccttggcttacaagacgtaagcgtaaagtgtagtgcgctttagtcagtatggccacatggtcctttggtggtaaattgtttgagatgcctccagtttttaaaaggagtagcatatcgggccaggagcagtggctcatgcctataatcccagcactttggaaggccgaggcaagaggattgcttgagcccaggagttcaagaccagcctgggcaacatagtgagaccactttgtttctttaaaaaaaaaaaaaaggcaaaaacaggctgggcatggtggctgatgcctgtaatcccagcgctttgtgaggcagaggtgagcggatcacttgaggtcaggagtttgagaccagcctggccaacatggtaaaaccccgtctctactaaaaatacaaaaattagccaggtgtggtggcacacgcctgtagttccagctactctggaggctgagccaggagaattgcttgaacctgggaggtggaggctgcagtgagccaagatcctgccactgcactccagactgggggacagagtgagacattctgacagtgctacactgaatgctacatgtcttcagaggaaggagaggttatgaggcctgggaataacatatggaagaatgaatttctgttatggtcagttctcatttgtcatgttaggattactgcaactcttacccagccgggtgtggtggctcatgcctgtaattccagcactttgggaggctgtgggcggatcacgaggtcaggagatcgagaccatcctggctaacacggtgaaactccgcctctactaaaaatacaaaaaattagcccagcgtggtggcagacgcctgtagtcccagctactcaggaggctgaggcaggagaatggcatgagtcctggaggcggagcttgcagtgagctgagatcgtgccactgcactccagcctgggcaacagagtgggactccatctcaaaaaaaaaagaaaaaaaaaaggattaccgcaactctttaattcagatcagcaaacatgttgagagccaggtattgcgtcaggcaggatccaaggataatgaaatattgtccgttttcatgaaactggagatgttgcagggaccgaggtgtgtgctatgccagtatggaagtaggacaggggagacgacagggcagtgagtggttcaagactctggctctgaagtcaaacagatctgggactgaatcctggatctgccacttcctagtcagaatctgagcctctattttcttatctgtaaaagaagattataacagtgcttatcttgtaggtactgttgacgattcaataagataatgtggataaaatgcttagcatagtgcctggcacatagtaagagctcggtaaatctaagttcttactaaatatccaagaaaagagattaattcttttcaggagtgagagaaagtcatcattattgaggggctttatcagatgggaacacctgaatagggttttataggatgaataggaattctttccacgaagttgcgttacaaaaagttgcattcaaggctgaaggaacatgagggtgcagaggcttaaaacagccttgtgtgttcagggagctataagtagaagttcttaatttaggagaactaaaccaaggggaaaggaggccaaggaaccacagttcttatcccttttctgttaataattgggtttaaatgtcattaaaataagttattttgtcctttttagaaaagtaataacatgctattataaaaaaaaagacttgtaggaatataaaatgtgtgttttacatgtatcctgttaattgacttgcttttattcagattttttgcagccctttctgtttaccaggttatcttggagacatatttattccaaattcctttttttttttttttttgagatggagtctcgctctgtcgcccaggctggagtgcagtggcgctatcttggctcattgcaagctccgcctcccgggttcacgccactctcctgcctcagcctcccgagtagctgggactacaggcgcccgccaccacgcccagctaatgtttttttttttatatttttagtagcgacagggtttcaccgtgttagccaggatggtctcaatctcctcacattgtgatccgcctgcctcggcctcccaaagtgctgggattacaggcgtgagccagcacgcctggccttccaaattccttttaacagcctagcaaaagaataataaggaaggtaaatctgcccctacaagaaaataatgcttcgacgatccggctttccttcctgctacccccagccataagaataaatgaccttgctcatcactgaaattttacctgacctttgaatttttaactgcgtcagccaaagaacttatattttgagtattcctaaggtgattgctattgtagttttgaaacacttggttggtatgtttgagggtttcatggtccaaagttactatagcagttaaaagagtggactatcaggtcagacctattgggctttaatcccagttctgccttctcttagaccttgggcctgttgttttcacttctctggttttcagtttctctgtccacaattgtggaaacgaggtccacttgtagagtaattgagaggatgaagcaagatgatgcatatcaagtactttgcatagtgccgggcagacaggtaacattcaagtgctaataattactattattactatttattttttgagacaggttctcactctgtcacctaggctggagtgcagcggtgagatcacagctcatgacagccttgacctcctaggctcaagtgatcctcctgcctcagccttcggggtagctggggctacaggtgtgtgctaccaccctcagctaattttctaatttttttgagtcaggatctcgtcacgttgcctaggctgaattactcttattaaaaactataatatcaggccgagtgcggtggctcacgcctgtaatcccagcactttgggaggccaaggcgggtggatcacctgaggtcaggagttcaagaccagcctgcccaacagagtgagaccccccccgtctctactaaaaatataaaaattagccagttgtggtggtgggcacctgtaatcccagctactcgggaggctgaggcaggataatcgcttgaacccgggaggcggaggttgcggtgaaccgagatcgtgccactgcactacagcctgggtgacagagtgagactctgtctcaaaaaaaccgaaaaacaaaaagcataattagggtggtaacgcttatacataggggcaggtggaataaaacataattaggaggtcgggcatggtggctcacgcctgtaattccagcactttgggaggccgaggcgggtcaggagttcaagaccagcctgcccaacatagtgagaccccgtctctactaaaaatataaaatttagcctgttgtggtggcgggtgcctgtagtcccagctacccgggaggctgaggcaggagaattgcttttgaacccaggaggtgggggttgcagtgagctgagatcgcgccgctgcactccagcctgggagacagagcaagactccgtcacaaaaacaaaaaacaaaaaactgtcatatcaaaaactaaactaaaatggtaatatctgttagatattacaaagtcaggcaaattatgattcatggcagccactaatgacccaaaggagagaaagaataattagcagattctaacctaatgggaaaaaaactaaatgaatagggatgggggacttacattctgttagaggaaattgaggctgtcatataaaaggaataggtaaggcaaactgtaaattcctgtttacacaaatgcccttctgataaatctctgcattgcccacagtccatgattacctctcccttattttaagtaatatttaacacattaaaaatggattaccacccaaggaattgctcccgacccagaaagtgcaggtagtgttgaaggtttgaggggaagaggaatgattagagttggttgtgtctcaggaagaagccaacaggaggaaccttattttgagtcaggtaaagaaggtgggagtgaggaggcatcccggtggccaggtatgaagctgggagctgattgctgcacattactcagctgaattaaatgtgccctcacatctgtgtgtgtgcgtacatgcaaatgtacatgtgtatgagttagttggaggggtagacctttattttcctgtcctgtaactttcctttgcaaactaatctgtattcagaacagtgttgcagttaagaaccacccagcttgtccatgaaacaggttctctcaccccatctccccagttttagagaaggcaggaaagaaaaggcagtgcttttcttttttcctggccgtatgcggggcaggaagaagccagcagagcttgaaagagaaagtaaaccttctgggaaataaacggcttggcttccctattgtggaggaggagtgcaaattattagggggatgtttgggtagtttttgtagaagccatttctgaaaactgatttggattagtgaaggtaagcccaatttaggaaaaccctgcccagtctggtgtcagccacctgtttcccgctttgtttgattgatttgattagtttgtggtattctgacctctcatttttattacaagagttggaagatttgagtctgaacttgagcacctgcttcggtgaaagcttcctaaaatgcatgttttttcacattttttctcatgttcattttgttttgctttttagcaaacactttttctgacagaatctaaaagcattagacttttcttgttttccccttctctccccacaatgtaatcttgaaaacccaaatgttagctgtgtaaattacctctcccgtaaaccaaacaaagtgcaatattgcattgagttagcattgaaatagtcggcctttgaatttttttctacttgtggtttagacataataaatatttcatctcagactgactttctcgacaaatcagttttgcatttgggcctcttttcatcagtatgtttagggaaagcacatttattgaaacattaaccaaaatgaaacataattaggaggccgggagcgatggctcacgcctgtaatcccagcactttgggagaccaaggcatgtggattgcttgaggtcaggagttcaagaccatccttgccgacttggtgaaatcctgtttctactgaaaatacaaaaaactagctgggtgtggtgacgcgtgcctgtaatcccagctactctggaggctaaagcaagagaatcgcttgaacctgggaggcagaggttgcagtgagtcgagatcgtgccactgcactccagcctgggcaacagagactccgtctcaaacaaccaaaaaaacaaaaacaagcataattagggtggtaacgcttatacataggggcaggtggaataattgaagcattctggagccagaaataatcaactgattaagaataatctggctgggtgcggtggctcacgcctgtaatcccagctactcaggaggctgaggcaggagaatcgcttgaacctgggaggtggaggttgcagtgagccgagatcgcgccattgcactccagcctgggctatggagcaagactccatctcaaaaaaaaaaaaaaaaaaaatcctgtttctgcagaaatatcccaggtgtcctgggtcagcagtgccccatagattccacggacgtttaccctaagttttccaatgggagttcatacctctatacccagtgagaatattttctgagtaatgggaatgagattggagatgtagggtagagaagatccatacagtctttgggttaaactttttcctctttgcctaggaaagattaatgctaatcttaaccacagatttgtagtaagaatgtatcagttttgtcattcagttctagactccagttttctttattgtaataccaatattttagagtaaattttgaaatgaatcagtacaaaagatatgtagtaagtggaaagttagtccgcaccttatccttgggactctttcccagggacagctagttacctactatttatctctcctgagttacttcatatgtatgcatgcaaacatgttattctctgggtgttgttccttccatatatagcagcaaatacaccaaactctgtattttgctttttgtcactttatcttagagaatactcaatgcaaatacatgtgtatatacctcatgtttaaaaaatctacatagtaaaattagccaggcatggtagtgtgtgcctgtaatcccagctactcgggaggctgtggtgggagaatcacttgaaccctgagatcacaccactggactccagcctgggccacagagcaagattctgtctcaaaaaacaaaaacaaaaacaaaaaaactacagagtagtattctaggctatgcatatcataaatttgatttcctaatgataggcatagatgatttgcctgggcggcaaattagcgttggctgtgtctcaggaagaagccaacaggaggaaccttattttgagtcaggttccaaagacagaaacattgtctgacatttgtttttgggcttatatgaataaatctgtacacatatatttttaatgttttaatcgtaatatgtatactatttggaaatgtggctttttagttaacagagtgcatgttttaccccattgcacttaaacattaacttggggataattaaatgagtctgtcacttggacaggcaggaattgtaccccccacaaacccataaaccgccaattttttttttttgagacagagcctcattctgttgcccaggctggagtgcagtggtgcgatctgggcccactgtaagctcagcctcccgggttcatgccattctcctgcctcagcctcccaagtagctgggactacaggcgcccgtcacaatgcccggctaattttttgtatttttagtagagtcggggtttcaccatgttagccaggatggtctctatctcctgaccttgtgatccgcccgctttggcctcccaaagtgctggaattacaggtgtgagccaccgcacctggccggtttttttttttttttttgagatggagtcttgctctgttgccaggctggagtgcaatggcatgatctccgctcactgcaacctccacctcccgggttcaagtgattctcctgcctcagcctcctgagtagctgggactacaggcgtgtgccaccacgcacagctaatttttgtaattttagtagagatggggtttcattaataatcattaatattagacaactgtcagactcacagtggtggatacaaactttctcaaattctgatttttactctaaagctcaaattttatcattggcaacaaatattgtcagttgctttccctgaacagacagcttcccttctttcatttttgagaaaatatctgccagtatcccagttggtttatcaatcattctttctctttttttttttgagacggagtctcactctgtcacccaggctggagtgcagtggcatgatctcggctcactgcaacctccacctcccaggttccagcaattctcctgcctcagcctcccgagtagctgggattacaggggctagcagccacacctggctaatttttgcatttttagtagagacagggttttaccatgttggccaggctgatcttgaactcctgacctcatgatatgcccaccttggcctcccaaagtgctgggattacaggtgtgagccattgcgcccggctctattatttcttttctttctttctttttcttttttttttttgagatggagtttcgctcttgttgcccaggctggagtgcaatggcgcgatctcggctcaccacaacctccgcctcccgaattcaagtgattctcttgcctaagcctcccgagtagctgggattacaggcatgtgccaccacacccgtctagttttgtatttttattagagatgggggtttctccatgttggtcaggctggtctcgaactcccaacctcaggagatctgcctgcctcagcctcccaaagtactgggattacagttttgagccacctgacccggtttgcttattatttcttttaaatttaaaaaataataaataaaggggccatgagagcgaagagtttgagaaaggttggtctaaaggttttaacataagaatccctgggttatttgcttaaaaagaagaaagaatctatggatctgcctgagagggtctgatgtagtttatctggggtcatcctcacaggcatagcagatattctgattcagatggtccttggtccttagtttgagaaatgtggctttacaaggcccatagaatataaagtcttctttggattagtgaagtcatgtccacagggtttagaaaatgtttttgttttagagataaaggtaagtggaagagtagacatgtagtgaatgagggaaaatgttttagagatttctttttattctgtttactcttcttggtatgcacgtacctgaatattaaggatattttatgaagtcatgacattaccagattaatgttggttttgttttaaggtactttctgactgctggggttaattcctacagacgattctggtaaagaatagcctttaagttttaaaagtgttgacttatttcagatgtcttaataaagttaacttccagttattacatgtaacgtatataaagctctcattttcctttattctcgttaattgtttgcataacaaattcaaagggaaatttgcttggcagagatcagatagcagagatgagatttaaaaacaggtaatttggctactagcctgggagtttgaagattccaagtttgcatccatgtgtagtcacttaacatttctgtccttatctgtaaatgggaataacacctacttgatagggttgttacattatcttggccacctcaggttctctttggctgagtgattgactggaaaacgcaatgtgaattcatgcttcagactgggttcttttttttttttttttttgagatggagtttcactcttattgcccaggctggagtgcaatggcacgatctcagctcactgcaacctctgcctcccaggttcaagcgattctcctgcctcaggctcccgagtagctgggattacaggcatgcaccaccatgcctggctaatttttttgtatttttagtagagacggggtttcactgtgttggtcagactggtttcaaactcctgacctcaggtgatccacctgcttcagtctcccaaagtgctgggattacaggcatgagccaccgcacccagcccaggctaggttctatatgggtgtgctttttagaatttagatcatgggctatccccaacacaaactggataatgtttctttctagattctctctaagcgtgtattctctttctttcctaggcacagccaccacttcacttacattgtgggattataatttcatgagtagtggaatttccttaaccttctcttgtgtgggagctgaaggacaaaatgagatattctctgaagagtggttacatcatgcaaaactatgatgtgtaatgaggtcacttagttttctaagtacattatacattttgataagattttcatagaaaagcttgtctccttggggagatcactcatcttccatcttgactattatttaaactttatgggtcagatttatctttttaaaaacttaaccataaagctcaattaattttttttttttttttttgagacggagtctcgctctgttgcccaggctggagtgtagtggcgcgatctcggctcactgcaagctctgcctcccaggttcatgccattctcctgcctcagcctcctgactagatgggactacaggcgcccgccacgatgcccggctaattttttgtatttttagtagagacggggtttcaccgtgttaggatggtctcgatctcctgacctcgtgatccacccgcctcggcctcccaaagtgctgggattacaagcgtgagccaccgcgcccggctcaattaatatattttaaaaattaatagactttattatttttattttattttatttttgaggcagagtctcgctctgtcacccaggctgagtgcagtggtgtgatcttggctcactgcaaactccacctcccgggctcaagtgattctcctgcctcagcctcctaagtagctaggattacaggtgcctgccaccatacccggctagtttttgtaattttagtagatacgtgttttctttcttttcttttcttttttttgagatggagtttcactctttttgcccaggctggagtgcaatggcatgatctcggctcactgcaacctccgcctcccaggttcaagtgattctcctgcctcagcctcccaagtagctgagattatagttgtctgccaccacgcctggctaattttttgtatgtttgatagagacagggtttcactatgttagccaggatgtctcgatctcttgacctcgtgatccgcctgccttggcctcccaaagtgctgggattacaggcgtgagccactgcggccagtctagactttattttttaaagcagtgttagttttacagaaaaattatgtggaaagtacagagagtttccatataccccttactttctcccacaacttctattattaacatcttgcattagtatagtacgtcccttacaactaatgaaccaactcgatacattattattaaccaaattcctgagtttattttatttctatttttattttattattattattttttagaggtagggtctcactgtgttgtccaggccaggttgcagtggcatcatcatagcttgctatagcctgaaactcctgggctcaagcaatcctcctgcctcagtctcccaaagtgttggaattacaggtgtgagccactctgtccagcctgaagtccatagtttacattacatttcactctgttgagcattctatggattttgacaaatgtgtgatgatgtatatttgccagtacacaattatataaaatagttttactgccctagaaaccccctgtgctccacctattcattcctctgctgaaccactggcaaccactgatcttttataatatctccatagttttgtcttttccagaatgtcatatagttggacatacagtgtgtagccttttcagattggcttctttcagtaaatgatatgcatttcaggtttcttcatgtttttttgtggcttgataggttgtttcttttcattggtgagtaatactctattgtatggatataccacatgttgtttatcaaacattcacctgaaggatagacatcttggttgcttccaagtttgagcagttatgaataaagctgctataaacattccagtgcaggacttttcacctcctctggataaatatcaaggagtgcaattgctagatcatatggtaagagtatgtttagttttgtaagaagctatcaaactatattcaaagtgactgtaccattatacattcccatcagcagtgagtgagagttcctgttactccacatcttcaccagcatttagtggtgtcagtgttttggattttagccattttaatgggtgtataatggtatacctattaaaattggttttttttggagacagagtttcacagtttcactcttgttgccctggctggagtgcaatggcgcaatctcggctcactgcagcctccgcctcccagtttcaagtgattctcctgcctcagcctcccaagtagctgggattacaggtgcacgccaccatgttctgctaatttttttgtattttagtagagatggggtttcactgtgttacccaggctggtcttgaactcctgagctcaggtaatccacctgcctcagcttcccaaagtgttaggattacaggcatgagccaccgcacctggcctcaatttttttttttttttttttgagacagagttttgctcctgttgaccaggctggagtgcagtggcacaatctcggctcactgcaacctccgcctcctgagttcaagcgattctcctgccacagcctcctgagtagctgggattataggcgcccgccactacgcctggctaattttttttttttttttaattagagacgaggtttctccatgttggtcaggctggtcttgaactccccgttctcaggtgatccgcctgcctcagcctcccaaagtgctgagattacaggtgtgagccaccgtgccccgcctgttttggcttttactgtgaagacgtgttagccgctgtgatgactagcaagtgtggccctccacccagtcgctctgggctcccagctcctgcatcctgctgcaaacttgacatcttccctcaagtaacttgtagttgtctcctgtctacttgcccaaaatataactcttaaacttttctctctgcaagtttgtgcctctctccctgtctgacttccccatctaaataaatggtagaccaccatctactcctttgtgcaagccagaaatctaggaatcatccttaaattccctgttctgtcttatctctgctttcattcaaagcatcagcaaatcctgttggttctacctctgaagttttctcaaatactgttacttgactcatcctgacttttgtttctgctttatgttaggctaaatgccctgaaaactcttttgtacaaaacacctagaaatactggataaactgggcttaacagggaggcccggtgtggtggctcacgcctgtaatcccagaactttgggaggccaaggtgggtggatcacctgaggtcaggagttccagaccagcctggccaatacgtagtgaaaccccacctctactaaaaaaaaaaaaaaaaattagctgggtgttgtggtgcacacctgtaggtggtgcatgcttgaacttgggaggcggaggttgcagcgagctgagatcgcgccactgcacttcagcctgggtgacagagcaggattctgtctcttaaaaaaaaaaacaaaaaaagaaaaacaggaaaatcttcagaagcaaaaaccaaacaatctcaccaaagaaatgagaagatggctgggcgcggtggctcacgcctgtaatcccagcactttgggaggccgaggcgggcagatcacccgagatgggcagatcacccgaggtcaggaattcgagaccagcctggccaatatggtgaaaccccgtctctgctaaaaatacaaaaattagccaggtgtggtggcaggcgcctgtaatcccagctactcaggaggctgaggcaggagaatcgcttgaacctgggaggcggaggttgcagtgagccgagatcatgccactgtactctagcctggacgacagagcaagactctgtctcaaaaaaaaaaaaggctgggtgtggtggctcatgcctataatcctagcactttgggaggccaaggtgggcggatcacttgaggccaggtgaacatggcgaaaccccatctctactaaaaatactaaagttagctgggcatggtggtgggtgcctgtaatcccagctactcgggaggcgaggcaggagaatcgcttgaaccaggaggtggaggttacagtgaaccgagatctcgccaccgcactctagtctgggcgacagagcaagactccgtctcaaaaaacaacaacaaaaaaccaacacatggccaaagtgcagtgacttacatctgtataatcccaatgttttgggaggctgaggcaggaggatcgcttgagtccaggaatttgagaccagcctgggcaacatagacctcatcaccaaaaaaaaaatattttttaattagctgggtttggcagcatgtacctgtagtcctagctactcaggaggctgaggtgggaggatcacttaggcccaggagtttgatagttcgaggttatagtgagctatgatcctgccactgcactccagcctgggccacagagtgagaccctgtctcttagaaacaaaacaaaacaaaaaaaagaaactgaattaaaaacaacaagaacaaaaatgctgctttttgttattgagttgtagcccaagtttcttgagggtaaagcattgaaaagcaggcagtaatagatttgctgtttaaagagatttacttgcagcactattcacaatagcaaagacatggaatcaacctaaatgcccatcagtgacaaattggataaagaaaatgtggtacatacactgtggaatactatgcagccataaaaaacaacgagatcatgtttttgtttgtttgtttgtttgtttgtttttgagatggagtcttgctctattgcccaggctggaatgcaggtggcacgatttcagctcactgcaacctccgcctcccaggttcaagcaattctctgcctcagcctcccgagtagctgggattacaggtgccctccaccatgcctggctaatttttgtatttctagtagagatggggtttcaccgtgttgggcaggctgttcttgaactcctgacctcatgatcctcccacctcggcctcccaaagtgccgggattacgtgtgagccaccgtgctcggctgagatcatgtttttgcaggaacatggatggagctggaggctattatccttagcaaagtaatgcaggaacagaaaaccgaagaccacgtgttctcacttataagtgggagctaaatgataaggacttgtgaacacaaagaaggaaaccacagatactggggtttacttgagggtggagagtgggaggagggagaggaacagaaaagataactattgggtattgggcttaatacttaatattttatcaaaataagctgtacaacaaacccctctgacatgagtttacctatataacaaacttgcacgtgtaaccccaaacctaaaataaaagttaaaaaaaaaaaaaaaggctggttgcattgggaggctgaggcaggcagagcacttgaggccaggaattcgagaccagcttggctaacgtggagaaaccctgtctctactaaaaattcaaaaattagccaggtgtggtggtgcatgcctgcagtcccagctaccagggaggctgaggcaggagaattgcttgaactcaggaggcagaggttgcagtgagctgagattgcaccactgcattccagcctgggcgacagggcgagaccttgtctcaaaaaacaaaacaaaacaaaacaaaaacctgtcactttgggaatatctcaaacctagtcatccaagtggttgtacgattttagtgtctgcatatcaatatttagtgtgatctactttcttagattctcaaatactgccaatgggcacatgtcatgaaataatgtcttttagaggacaagagagtgctaaagtctcattattgcagtttaagaaaaacaattctgtaacagtttaactttataggaaatgccttttgtttatttattttttttcttttgaggcttagatttttatttttatgtttttagagatggggtcttcctatgttacccaggctggccttgaattcctgggctcaagtgatcttcctgcttcagcctcctgagtagctgggactagacgtccactactgctcctggctggaagtttagattttaatttaaactcttctattgggaaactttgtatgtttgctttaccacttaacatttgcatgcattattgtacctattgtctcctacttaaggaagggcagtttatgctgttatatgaagtgaattaacctcctatggtacttcagttttctctatgctaaaagtgtgttctagatttttgaaaaacttacttaattttcattcatttattcaaatatttgagcattctgtagttgctggggaaatagcagtgaactgaagaatgtctttgttcttatggggcttaagttcctagttgatcatattggaaggagatacatgaaaaaagaaatatatgaacaatggagggcgatgagtactgtaaaggagaattcagcaggggagatgttgctgttttagatagaggggtgtcaagagacattgtgcagagacctgaacgaagtgagggagcaagccatggagatatctagggaaagagcctatcaggtggagagaagagtcctagggcagaaacgggcaaggtgtgttccaggagcagagaggggacagctgtgagcaaggggagagttgtagggaaggaggcaaagagagacatctggggcaaaatggattgactggtgggccgtggtaggactttggattttttcctgagtgggttttgagcaggggaatgaaatgatctgactctggttttttttttttttggagacaaaatcttgctctgttgccgaggctgaagtgcagtggcgcaatctcggctcattgcaacatctacttcctgggttcaagctatgctcctgcctcagcctcccgagtagctaggattacaggcttgggccaccatgccggcgaatttctgtttttatttttattttttatttatttttatgtttatgttttttgagacggagtctcgctgtgtcacccaggctggagtgcagtggcgcgatctcagctcactgcaacctctgcctccccggttcaagcaacttctcctgcctcagcctcccgagtagctgagattacaggcgcctgccactacacctggctaatttttgtatttttagtagaaacgggatttcaccttgttggccaggctggtctcgaactcctgaccttaatttatctgctcgccttggcctcccaaagtgctgggatgacaggtttgagccaccgtgccagccaggactcttattttgaaaggatctgtaatgtggagaatagaaggtagagggacaaggatgaaagcatccaggccagttagcctagtccagctatctaggtaagagatgctggtggcctggattaaggctgcgtcagtgggaggttgtgagaaaggctcaccttccttttttttttttttttttttttttgagacaggatcttactctgtctcccaggctggagtgcagtggtgcaatctcagcttactacaacctccgcctcctgggctcaagtgatacccccacctcagcctcccaagtagctgggatcacaggcttgcgccactatatccggctaatttttgtatatttcgtagagacagggttttgccatgttgcctaggctggtctcaaactcctgagctcaagtgatccacccgcctcagcctcctaaagtgctgggattataggcctgagccattgtgcccggtcacttccagattttgaagacagagccaacaggatttgttaatggattaggtgtggcaggaggagggggaggaagagagagagagactggagttgaagttaaggctcatttcaaggtttttagcctcaacatgtgcaggaatggagttgtcacttgctagaatgggggagactggaggagaagccggctgggagaggtttttaatgaaggggttggctttggatacattaagtttgacatgcattttagacatccaggtggagatattgaagaggcagttggctataagtgtctgatgttcatattagcggatggggctagagacataaatttgagaattgtcagtgtataaacgttgttttgaaagaaagtggggctgaataatttagaaaggagtgcatagagaaaataagtttactattaaaatagctttaacaggccgggcacggtggctcatgcctgtaatcccagcactttgggaggctggggtgggcagatcaaaaggtcaggagtttgagaccagcctggccaatatggtgaaaccctgtctctactgaaaatacaaaaattagccaggcgttgtaccgggcacctgtagtcccagctacttgggaggttgaggcaggagaatcacttcaacccgggaggtggaggttgcagtgagccaagatcacgccactgcactccatcctgggcaacagagcaagactccgtctcaaaaaaaaaaacaaaaaaaaacaaaaaaaaaaaactttaacagcaaagcctcttcctttaaaattatgaatttttttcttatggaagttggactctttcattattaagtctacattcaatcactatgttagtaaaaatgttgttctagttgccgaatgcaataaaccagctcagacttagtggcctaaagcagcaatcatttgactatgttcgaagatgccgtgggcaggaatttagataacagcagggatggcttgtctttgctctgcgatgtctgaggtctcactgagaaaactcaagcggctgggggtaataatcatctggaattttctttactcctgtatctgatgtctgggctgcgatgactcaaaggctgatttcagctgagactgtagaccacgtgcctacttgtggcctccccttttgccttgggtttctcacagaatgtggctggttctggagaatgagacttccaatgaaatcaggtggaaatgacatctcgccgctttcagcatgctctattggttggaacagttatggacttagctagattcaaaggaagggaacaaagaccccctcctctcagagagtggggcataatgagagaatttagggccatgttatccaaccaccacaaatgccttctgaatttgaggttctgcctcaaaagttcatagttcctttgactgaaggacttctatatatccaagcatcgtcagccccaggtatattgttccatgtaagtgaccaggactaccttagtatttcgtatagggaaagtgacctgaataaatttgagaaaagaatcttccttctctccagtaagcactgaggtaagcattgagccatattataggtttatgactttgagactcagaaatttaaattcttggccaggcgcagtggctcacgcctgtaaccccaacactttgggaggccaaggcaggcagatcacttgaggtcaggagtttgagaccaacctggccaaaatggtgaaactccatctctacgaaaaatacaaaaattagccaggtgtggtggcgggcacctgtaatcccagctacttgggaggctgaggtaagagaatggcttaagttctctttatctgctttatttcagttgcctctcttagatgaatattaatgacttacatagcattttagatcagtggatgtttttgtgattcttttatttgagctttggccaaagataacagtacccacaggttttttccagctactcgctcttctcccttcagtggccctcgagcctggaaaatctgacatgacaatgtgcttgctcaacctaccactgtttttcttttgaaaagtttggcagcctgtttctgactcctatgaaggtgaattcctcagcattcacagtttattagaaaaatactttgcttctctccaaactcgaaattcaagataaccaaacctatatataggctgatctttcaggatgcagttgtcatgttgatgccatgcttttcagtatcgtggccatcatctgttcagtaggggaggtgtacttctgtaatgggaggtggtggttatgtgtgtgtgcaagtgtttatttggtgtcttaagttagcctgtgggaagttctaaatcaggatggtacgtggttgccagcagagagctgctcctcaagtgaaggaggtagaatcaaagccaataggaaagagcctcagatgcttatatatgtaccgtggggattcagagtgaaagcagtcattggactaggggtggggttagggagagcctgtctgacagacacaagaaagggatggataacgccacccagagaaaaaagcattttaggcaagaacaaatatgaaaaaggaacaaagtctgtgggtggggggcaaggaggagataagttgacttgaaggaagacaacacttatgaaagtcacctggaggctgggtgccatggctcatgcctataatcgcagcactttgggaggccgaggtaggaggacaacttgagcccaggagttcgagaccatcctgggcaacatggtgagactgagtctctaccaaaaaaaaaaaaaaaagaaaattatccagacatggtggcatgtgcctgtaatcccagttactcaggaggctgaggtgggagggttgcttgagcccaggaggttgaggctgcagtgagctgtgatcgtattattgcactccagcctgggtaacagagcaagaccctgtctcaaaaaatgaaagtcatctgtaggctggagagaggaactggaaggggctaaagttggctgagtagttacagagcctgagataagggtaaagattttgcattggacaatgagatgttagtgtgtgtttttgagctggggagtgctgtgattttactcttattgaagaatcactgaaggattattcttgaatcagtgattcttgatcattcttgaatttttcaaacagcaaaactggaagagttggcctattcctcagaatattttctaattgggcgcagtgtcctcacttgggagaacctggctacacactttagttgtaattcactccagtcgttcattcattcaatacctattttttcagcacctattatgagccagacactatgctggatgccagggttcagggtaggacacgctagtgagcaaaagccaagactcttcttgtcttcatggggctttcagtccagcatagtggttatgagtccaagttaatggagtcacagtacttgggtgcaagtcatggtgatggtgatagaaggaaggcatgtgtgagggccagtggcaggcaggagcctggtgtttttgaggacctgaagaaggagcagagtgagtgccaggaacttagccaccagctggtaccagccatacgagaggggcagagccagccaggatgtcggtcatgctagtaatgagtacaaacacttacatgctgcacgctattgggctcctgagtgctacgtgttcattagctcgatgaatttgtacagcaaccctgtgaggtaagcactgttctctcccctttctatagatgaggaaattaaggcacaaagaggataaataactggcaccagctacacgctaagtgatcgaagtggtggaaccaggattcaaatccatgctattctgccttaagataacaaatcttgttttttagcctaagaacagagcagtcatcaggagggttttaagtaggggtgtggcaagatcaagtttgtgtcttgaaaaggtctctctacccacagtgtggaaaatggcctggaggcaagcacacagatgttgggagacagttaacagctcttgccatggccccctatgcattttggctctgatgtttctgcctgatttttctcttgcctctgcctcttttcctgaggggatggcaggttttaccattcagctggagtacaaaccctgaaccctttttggttaaatatctacttgcttttcctacagtattattttgagttgctgtggctgtaatgtcttgagggaatcgagcttgacagtaatttatagaacaaacagtttttagagactgtgtggcccaattgccctctcaatgttggcactcctgccatgacatttaccatgctgagcatgtgaccgccatctgaataccaaatgccacaggaacctgggaggttgtcacttactcctccctttctctgagtcacctttgcccttcagtcagtcaccaagtcccatcacatgtagctctgtaatgtcacagaagatggatgtctgcctcaaaacacttacaatgctgctacctaaattgggcagccacgacctcccaccaggattattgcagcctgagggatctttttgaaatgtaaatcaaactatcacttgtctgtttaaagcttttcaaagacttaccccattgcccttggaagaaagtgcagatatcttgacaggagagccttctccagcctcctcttctgccgtggtctccttgtacagtctctacagtgtactgcttcattagaaccctggagattattatttgctagttctgggctaagaactggcacctggctttgtagagctcctcaggagattctgaggcgtattcagagttgagccctgatctctgctctgatttcgaggttctcgttatatttattaatgatcacgaaaaaatttattattattctttggcctcactttagcatcatctgaggaatttttttttttttttgacagagttttgctcttgttgcccaggctggagtgcaatggcgtgatctcagctcactgcaacctccgcctcccgggttcaagagattctcctgcctcagcctcccaagtagctgaaattacaggcatccaccaccatgcctgctaatgtttttgtattttttagtagaggtgggctttcacagtgttggtcaggctggttttgaactcctgacgtcagctgatccacccacctaggccccccagagtgctgggattacaggtgtgagccaccgtgcccagccgtagctttcgaaatttgaaacctggtcccactgtcagaggttccaatttggcactggtttggttcccaggcatctttcttgctgtatatattttttagtgtcagccagggtggagacctctgtattacttcatggggaagaatttgggagaagatgttgtgaggagacaggttctagtcctagagtgatttatcctttctcgtacagatttccaggtatttgaggggccactcttctgtaattcatgtttttctctcctaacctcactcctgttgcctgcatcttcttgctgagcaaaatattcaaggtcttcaactcctcacaccctggttgtccctccctggatgtgtttggttgttttagtgttccatttcaattttgatacacagaattagaatagcatccagatgtgggtctgttacagctagactactagatccttcaaaatccaagtactagtatgtctattaaaataccataagatcacattggctagttacaatggttggtttgtgggttacttaaaaatcaactaaaattctttttttttttttgagatggagttttgctcttgttgcctaggctggaatgcaatgacacaatcttggctcactgccacctctgcctcccaggttcaagcaattcccctgccttagcctcctgagtagctgggattacaggcatgtgccaccatggccagctaattctgtatttttagtagagatgaggtttttccatgttggtcaggctggtctcgaactcccgacctcaggtgatccacctgcctcagcctcccaaagtgctgggattacaggcgtgagccactgagcctggccaaaattcccactttctaatactcctgtagtagctgggtacggtgggtcacatctgtaatcccagcacttttggaggctgaggctggaggatcgcttgagcctaggagttcgagaccagcctgggcaagatggccagacgccatctctaatttaaaaaaaagaaaaaacaagactcctatagtggtgaagaacagacattccgaaaacagactgtgcgttatgattccagctccatgcctttactacctgtgttgtgactttggataaatcacttaaaaatcttttttttttttttttttttttgagacggagtcttgctctgccgcccaggctggagtgcagtggcgcgatctcggctcactgcaagctctgcctcccaggttcacaccattctcctgcctcagcctcccaagtagctgggactgcaggtgcccgccactacacctggctaattttttgtatttttagtagagacggggtttcaccgtgttagccaggatggtctcgatctcctgtcctcgtgatccacccgcctcagcctctcaaagtgttgggattacaggcgtgagccaccgcacccggccaaatcacttaaaattctgtgcctcagtttctcctctgtaaagtgggataaaaatagtacctatctgatagggttgttacaattatgaaatgagcaaataagtatgtcaagtgtttaaaacagcgcctggcttcttgtaaaaagtgctatataaatcatagctataatcattacttatttcgactgctctttaaccaaggttcttatttttcatctttttcttttgttttgaatatcacttagtgttttcaccttttactctttttaggacctagagccatcctaggtgaaatacgtatggagatatttgatcaggtcaccacccagctctcctgacctcccttctctccttaaattaacatgccaaatcacagcatcactgactccttccctcccgatatgataagagtgtgcattgaaatgcatgtattttacttagcagggaaagctgattagtgattatcacacttaacccctagtgaatctgatggattaacctgctttccaggacactaaggaaatgggtttaagataagaaatatctggctgggtgcggtggctttacgcctgtaatcccagcactttgggaggccgaggtgggcagatcacgaggtcaggtgattgagatcatcctggctaacacgatgaaaccccctctttactaaaaatacaaaaaattagccgggtgtggtggcgggcgcctggagtcccagctactcgggaggctgaggcaagagaatggtgtgaacccaggaggcagagcttgcagtgagctgagattgtgcccaccgcattccagcctgggcaacagagtgagactacatctcaaaaaaaaaaaaaaaaaaagtaagaaatgtccatgaaagggagaccctgggggaaaggaacaataactgcagctctgaggatctggcaccagcagcaccagcacagagggatgctgtacaaccattattgattttaactttacaacagttcttcaaaggagagagagttccctgttttactgaagagaaagcccatttggtagtgaaataccattcccaaagacaaatagctaataaatgtcaggcagggttttgcacccaggcccatccagctcccgtctctactgtcctttcccccacaccacactgatacagaggaatgtgtctggttggggaagtggaagtgttcccaagtggggaggtcatctgatgcacaaatttggtctgttttgtgggttttcttgttttagttttagtttttgtagagctcagacctgttcttaggcagctttaacaatcaactgtgcactcagtaattgacaaatcatgtttgttacttttaatttagagggaattaggtttgttaagctcttgctccttctttagagatggggtctagctctgtcacccaggctggagcgcagtggtatgatcacagctcactgcagtctcaatctgctcaagtgatcctcctgcctcagcctccatgggactacaagcatgggccaccatgctaggctaattttaaaaaaatttttttgtagaggcaaggtctcacggtgttgcccaggctggtcttgaactcctgagctcaagcaatccctcttccaccttggcctctcaaagtgctagaattataggcatgagccaccatgcctggcctttacttctttcatatattcaaattttgtcatattagtagggaactataactcaagttttcttatagattgatgttcatttttacaagcttgatcgtcattggtttttaattttaaagcaaatcctgttatatgtaattgaacattacagtaattatagtaatttgtttcagattgggcactcaagtgttaatattttgtctctttaggaaatcaaaactagatttatatatagacttcttattgcaagtatctagtcttaaatcttacaaaggtactatttggacttaaaactatgaaattgtgtgcttactatataagtgtacttattttgagttatgttttaaacttgaaattccattcttaatgtctagagtaattatgaatggttaaattatgaatgactctaatagtttaaagctacagtatttatttatttatttatttaatttattttttgagatggagtttcgctcttgtcgcccaggctggagtgtagtggcaccatcttggttcactgcaacctctgcctcgcgggttcaagtgattctcctgcctcagcctcccaagtggctgggattacaggtgtatttcaccatgcctggctaatttttgtatttttagtagagacaggcttttgccatgttagcctggctggtctcgaactcctgacctcaggtgacctaccctcctcagcctcccaaggattacaagcatgagccaccacacctggcctacagtattttaatgtggactctctgtcatccattatgctgtttatcctgtggtgaaaattttatgaagattgaatgtttttctctagcgtgaattgctttctcttacttttctcatttttttccttcctaatctacttgcagatacttcagattatttttagaacgtggtatggtgagaacaaataaattggggtttccaaatcttaataaattatgtggccctcagtgggattagcagggttgtattgaaaacaccaatagaaacaaaatagttcttttatgcgctttaaataaaaatttcttttcaggccaggcgcagtggctcacacctgtaatcccagcaccctgggaggctgaggcaggcagatcacctcaggtcaggagtttaagacaagcctggccaacatggtgaagcgccgtctctactaaaaatacaaaaattagccgggtatgatggcgcatgcctgtaatcccagctactccagaggctgaggcatgagaatcacttgaactcaggagatggaggttgcagtgagctgagatggtgccactgcactctagcctgggcaacagagtgagattctgtctcaaacaacaacaacaacaataacaaaacatctcttttcaggccaggtactgtggctcacgcctgtaatcccagcactttgggaggccaaaacaggagggtcgcttgagaccaggagtttgagaccagcttgggcagctggtctctatttgaacaaacaaacaaacaaacacaatactcttttcatagaaaaatgtttactacacaataaactttaaaagaatatgcagctgtattaatgctatgactccaatgtaaaaaaaaaaaaatatatatatatatatacacacacacaaacacattctgaaatagatttaaaggaattacatcaacatgtcaatttttattttttcggagacagggtctcgctgtgtcacccaagctggagtacagtggtgcaatcacagctcactgcagccttgacttcctggcctcaagtgatcctcccccctcagcctcccaaagtgctggggtcacagaccaccacacctggcaacatgtcagtttttgttctgcatagtgggatggtgggatatggatgtttttatcttttattttcttttttatatttttctaaattttccacattgaacattattttataatctttcaaacatatctcttaaaaggactggttcctatagaattcagtgcaagaaatcttctgtgtttctttatactttggttgccttgatcactgggcctttcctgacagcaaagaagaggttagtgtaggcagcagataaaacacaggtatgctctatttaaaatgcatgtatttataataaaagtataggtggtacccaaaggaaaatgtcatgacacattgcaaagtggaacagaagttatctttagatcactttctgttctggattattgtatgagcctgattttcgtctctctttccgccttccctcaccctcgttgtaaatccactagtgcatggatgtgaagtacaagtcttaactttaaaaagttttatgaagctgtgtagtaaatcccttttgtaagtggtcttgactgcgtttctcaatatatcttttggtttcattagattcaagtatataaatgagaactgtaactttggacagactttttcagtcatctttacggtaataagttcccaattagacaatagttatttgttttatgacttgctgttggtaggttatccccaagggactgagaaattcctgttttgaaaagtccaaaaagtctttgatgacttgctgtttcatttttttcttttctcttcagttatagaaaacaggattacacccaccttgcctttgtacagtgcatctactatctgctgacttaacctgagtaaatgctttgaattgagccccatataatgtcctaaggcagcctatatggagtaatgaattgtcttctctcttatgcacccagagtggtagttggcactcaagttgttcctcagataactttgtgtgttctggggctcaatgaagtagttattaagtcacaggcttggggagaacattcatcctatggcattgaatgaagtgttgcccaattctagaatgtctaataaaatttttttaaaaacccacaggcttagaattattccgtagatatgaagtaatgtagttagaacttagtggagttctttagattaacttgtaatttgaaaaaccaaaattgaaattgtgaaataacatgggctctttgaggtcttttccagtaaaacagttacagtaaagctgcttggcagtgattttcctagacactttggctagtcatctcctgtgactgctgttaattaaatatggtttgtagctaagcagcctgtaaggagaagactatggaagtatttgcatattctctccttgaaaatactacctggtctttggctttaagttatacttttattttcccctgtagaataactattaaagtattacctatggtgattagactaagaagtaaaacatgaaatcagtcattgttggtgccctggtgccttcttttttttttttttgagacagagtctcactctgttgcccaggctggagtgcaatggcacgatcttggctcactgcaacctctgcctcccaggttcaagcgattctcctgcctcagcctcccaagtagctgagactacaggcgcccaccaccacgcctggctaatttttgaatttttagtagagacagggtttcactatattggctaggctggtctcaaactcctgaccttgtgatccgcccacctcagcctcccaaagtgctgggattataggtgttagccactgtgcccagcctggtgctttaattttatggaaaaaactactagctggtttctgttttaagaaataacacaggccgggtgccatgacttgcgcttgtactcccagcagtttgggaggccgaggcgggcggatcacgaggtcaggagtttgagaccagcctggccaacatagtgaaaccccgtctctactaaaaatacaaaaattagccgggcgtggtggggcatgcctgtagtcccagctactcgggaggctgaggcaggagaatcgcttgaacctgggaggtggaggctgcagtgagccaagatcgccccactgcacaccagcccgggtgacagtatttcatctcaaaaaaaaaaaaaaaaaaaagaacacaattattgtactacttactagccctcctctgtccccagctaaaaataagaacagcaacaaccaaaaaatccttagttatgtactggaaatgaattagataattttcaataacttacacgtttttaggatatgttagtttgaaaatgcaaatattcatgcatgaccccagtgttaatctatgatggagcaggtatagtgggatgctgtttcatgatttaatttggaccttcagggagtagactgtgatgcctctgcatttgtatccaagacaaataattaaatagtctatttttggctgggcatgatgcctcatgcctgcagtcccagcactttgggaggctgaggtgggaggatcgcttgaggccaggagttcaagatcagtctgggcaacaaaatgagaccttgtctctacaaaaactacaaaaaattagctgaacattgtggcttgtgcccctagtcccagctactcaggtccctgagttaggaggattgcttgagcccaggagttggaggttacagtgatctatatttgccactgcactccagcctgggtgacagagagagaccctgtctcaaaaaataaagtctgtttttaaaattaattttaaacactggagtttattacaaaaagcagttggttctttttttaaatcatttttttttaggagaaccaccgctttttggctacattgtctagagtagcagtgttcaataaaaataagatccaagtcacatatgtaatgttaagttttcttttagtttctttttcttttcttttcttttctcttctttctttctttctttcttttttttttttttgatatgcagtctcactctgttgcccaggctggagtgcagtggcacgatctcggcccactgcaacctccgcctcccgggttcaagcaattctcctgcctcagcctcccgagtagctgggactacaggcatgtgccaccatacccagctaatttttgtatttttagtagagatggagctttgccatgttggccagtctggtctcaaactcctgacctcgggtgatccacatgctttggcctccctaagtgctgggattacaggcatgagccaccatgccctaccaatgttaagttttctagtagccatattaaaagaagtaaaaagaaatgggtgaagttaattttaataatatattttatttaacccaatatatctaaaatattatcatttcaacatgaacaagatactttacattcttttgtttttcactaagtcctcaaaatccagtgtgtattttatattgacagcatagttcagtttgaagcagccacatttcaagtgctcagtagccacatgtggctagtgactccatactggactgtgtaggtttagagtttcagtaaatttgtatgcaatagaatctacataaattggcatattatgcagatttctttgtatgcacatcagttcttgcatagcataagtcaggtcatgatgcttttagtctatgaggcagatttttttttttttttttttgagacagagtctcacttggtcacccaggctggagtgtagatgcacaatcttggctcactgcaacctccatgtgaggcagattttaacttggccctaatgcaaatattgtaagagagatctaatggcctttgatttcttacagagggcaatcaatacatgccatggttacaatgcttcagcatatagtatgcacgtcagccactgcttttactctggctagtgcttagtgtacctgtaccactgcccaggcagcatttgtcctgtggcaggtgaatcttagggtggaaggtggcaagtaacattgcttttttttgagagggagtcttgctgtattgcccaggctggagtgcagtggtgcgatctcggctcactacaacctccacctcccgggttcaagtgattctcctgcctcagcctcctgagtagctgggattacagacggccaccaccatgctcggctaatttttgtatttttagtagagacggggtttcactatgttggccaggctggtctcgaactcctgacctcgtgatccacccgcctcggcctcccaaagttctgggattacaggtgtgagccaccgtgcccagcctacatttttaaattaattaattataagcaggatctcactgtgttggccagactggtcttgaactgataagagttcaagaccagcctaggcaacatggtaaaaccctgtctactaaaaaatacaaaaaaaaaaattagctgggcatggtggtgcgtgcctataatcccagctacttgggaggctgaggcaggaaaatcgcttgaacccgggagactgaagttgcagtgaggtgagattgcaccactgcactccagcctaggcgattccatctcaaaaacaataacaacaaaataacattgttggaatatttagttaatttatagaagcgtattggcctaattggggcaaataccttattctgacattctctctatttgctttactgagctttttcaccagtggaatttaagcccttgatacatgaggagggaaaataccttggagctgtgctgcacatgtaaagtacacaggagatttagaaaacttcgtagcaaaaaaaagagtgtaaagtatctcattaatagtttttgtgggctggacacggtggctcaagcctatactcttggcacattgggaggctgagatgcatgagtctaggagtttgagaccagcctgggcaacacagtaggaccccgtctctacaaaaataatcagccagatgtggtgcgcatctgtagtcccagttacttgagaggctgaggtgggaggatcgtttgagctgggaagttgaggctacagtgagctgtgattgaaccactgcactccagcctgggtgacagagtgcctgtctccaaaaaataaataaataaataataatatgttttgtatgttcatatgttgcaataacattttggatatattaaatgaaataaaatacattaaaattaatttcacctgtttcttttcttttcttttttttttttttttttgagatggagtctcgctatgtcatcaggctggagtgcagtggcacgatctcggctcactgcaacctcctcctcctgggttcaagcgattcttctgcctcagcctccctagtagctgggattaaaggcatgtgccaccacacccagctaatttttgtatttttagtagagacggggtttcaccatattggccaggatggtctcgatctcctgacctcatgatccgcctgccttggcctcccaaagttctgggattacaggcgtgagccactgcacccagcctcttttaactttttaagtatggctaccagaaaatttaaaatgcatgtgtggcctgtattctatttctgttggatgctgctgccttagattattaattattcaatgtaaagactgctgggaggtactacctgcacttccctgaatatatgcttgagagctccaccagccgtcttcacagtagcaagaggggtattctgagtctgtcccccaaagagggagggagaagtgcagccctctcaggttctgtcagaaaacctgatcccaggccaggcgtggtagcttacgcctgtaatcccagcactttgggaggttgaggcaggaggattgcttaagcccaggagttcgagaccagcctgggcaacacagtgaagaccctatctctacaaaaatttttttaaaaaaattagccaggtgcagcaatgctgcctgtactcccagctgcttgggaggctgaggtaggaggattgcctgagcccaggagttagaggttgcaggagttagaggttccacgatcgcacctttcattccgttacatttgctgccttgagaacagaagacctgctggttttgttgccagtttgctcagtcatttttatgaaaaagccagtgctaactaggtgcttcttcgtgccttctctgagaatcaagaactctagtatgtttgcgtgtgttcagtctctcattaaatgttctcactatcccagagaaccatctcattggaccttggtctgtacataccttcatctttggctctgacttgtaattatttttagaacttctctttttttttttttggagacagagttttgctctagttgccagactggaatgcagtggcacgatctcagctcacctcaacctctgccttccaggttcaagcaattctcctgcctcaacctcttgagtagctgtaattacaggcatgtgccaccacgcctggctaattttgtgtttttagtagagacagggtttctccaagttggtcaggctggtctcaaactcccgacctcaggtgatctgcccgccttggcctcccaaagtgctgggattacaggcgtaagccactgcgcctggcctaattttagaacttgttaaaacaacttggcctctattgatatttccatgacccatgctattcagaaagaggattacaggtaattagctggctgggtttctcataccagagcatttcactgggatgttcctgaacctgggacaacttttatgcctggcatttttctttccttctctgttgtcccagactaagcaatttttaaaatagttattatttgttgagtaggagaatctcaggcagatcttcctggatcctcatttatacttttaaacctgtagtcttggaattagtgctctgtcccccaaccccaaacatccaatttctacattttggctacagtacaggtttactgtgtataactaaaagggctgtggaggagaaagaaaggaaccgacatttgttgggcatctgttatgtgccatgcactgagctggatgctgtaggaatatctcaatacctctgaggagtgggaattattatctctattttatagacaagggaatagaaatctgggagttaagtaattttttaatttcacacacttctggtagataatggattctagaacctggcataatagccacttgtcatcccagtgtaaaagagatgtgtggccagatggggtggctcacatatgtaatcccagcactttgggaagccgaggcaggaggatgacttgagcccaggagttcaagaccagcctgggcatgttttgtttgtctcacgaaacattttttaaaaaatgagtgtggcatggtgttgtgtgcctatagtcccagctcctcgggaggctgaggtgggaggatctcttgagcccatgatcatgccattgcactctagcctgggccacagagcaagactctgtcttcaaaaaataataaaaaggagctgtgattatcccaaggtggggattgtgaatgtgtttgtattgttctaaactgggagaaacaggctgggtgtgttggcttatgcctgtaatctcagcactttgggaggccaaggtgggaggatcacttgagtccaggagttcaaggccaccctgggcaacaggcaaaaaatagagaccccatctctattttttaaaaataaaataaactgggagaaagaagcagggtcctccccagagcatctttatccctagtcacagacctgacacctgtgttgggcaatggctacttctagattgtttacccctactgggacttgtggtgaacatatgcacactttggtttacagttgggacccctgattttagcaggatggcccaatggaatcagctacagcagcttgacacacggtacctggagcagctccatcagctctacagtgacagcttcccaatggagctgcggcagtttctggccccttggattgagagtcaagattggtaagtccttcttaagtgactctccaaattgttaggtttcagtttgagtcaagagacatgaactcttaatgtcatgccttgctgttccattaaaaaatgtatgggtacaggtgatggggaaaatgagatcaggagataaaggggcaccctttggtcttgtaaagccttttttatcttagaagggcatgtgggcaactgtctttgacacattgaaaccgcctgtatggtggtggatgtcttgaaggttgatttggacctcatttacttgggcagatcctctatatattctgataatccagtgatgtggtagacatattttttctctgaatgtgaattctgtcatagctagaactttgggttgatacttgtaattcccctttagttaaaggaaggagccacaggggtgtattagtctgttctcaatttgctataaagaaatacctgagactgggtaatttataagaaaagaggtttaatcggctcatagttctgcaggctatataggaagcatagcagcatctgctgctggggaggcctcagcaagcttccaatcatggcggaaggcagagagggagcaggcaggtcacatggccacagcaagagcaagagagcaagggggaggtgccacacacttttaaactatcagatctcacaagaactcactgtctcgaggacagtatcaacagggatggtattaaaccattcatgagaaacccacccccatgatccagtcaccttccaccaggccccacctcaaacagtgggggttacatttcagtatgagatttgggcagggatgtagatccaaactagatcacaggataagggaagtagattccattcatagagcagataatggcacagatgtccagcaactattttcttcactttaatatgctcaggctcactactgattttggtttaattcaggccagtgttaatatgacctggtttttccagaatgcatactctgatttggtgaagggccaggaggtgattcacagatgttggagataggccatcccagcctgggattacttatttgtactaataaatctgaccagagttaattgagggtttaaagcaaaacagcatatctgtctactttgctcaaatattttacaaatacaacagattatgagagtgggtaataatatctggaataattgtttttttgttttgtggtttttttttttttttttttgagatggagtctggctgtagcccaggctggagtgcagtggtacagtctcggctcactgcacctctgcctcttggattcaagcgattctcccgcctcagcctcccgagtagctgggattacaggtgcccaccaccacacctggctaattttttatttttagtagagacagcgtttcaccatgttggccaggttggtctggaactcctgacctcaggtgatccgcctgcctcagcctcccaaagtgctgggattacaggcatgagccaccatgcctggcctggaataattgttaataattattacattgatggcattttattgctgagcaagaagaatctaacatgatgaatgggttatagcatcaggtttgctttgtttttttgtttttttcctctttcttgatggtgatttctgtgtttgtgtgtatgcgtcggcttcagagccattctttatcattcttccttttcctagggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcaggtatgatgagaaactgaggacaaggagaaacaggacccgcagagtcgggtgttagtgttctttcctggaagcatctcttttctcatttggctaagtaacgagaatctatcttgtattttcaatcacaggagaagtaattagccctttctcaaagctctgtatacttacccgtgagcatcattacctgagaatcacttctcttgtcacagttgaagtaataaagtgattgttatgttaatcatacatgttagcatgttaacgcggtccactgataggaagatgactctcactgttacatgttaaatgtttgaccataatgggatacttcttgactaagtcagtagcttccctgcaagaccaggatagtatactgtgtaaagactcagacaaggccaggcatggtggctcacgcctgtaatcccaacaccttaggaggttgaggtgggaggattgcttgagcctgggagttttgagaccagcttgggcaacataacaagacaccatctctacagaaattttttttaaaaactagctgattgtggtggcatgcacctgtagtcccagctactcagaaggctgaggtgagaaaattgtttgagcctgggaggtcgaagctgcaataagccgtgattgcgccactgcactccagcctggcggacagagtgagagccagtctcaaaaaaaaaaaaaaaagactcaggctaatgtgccttctgttacagaaatagtaacgacctccccttcgccccccgccgacagagagccttcacccaggctctgaagcctttgttccgttgtttcctagaataaatgctttccttgatgaatacattagttttaaggtgccacagttcagtccacatctccatggtctgctgctgatttttattctctttctctcctacttatagagcaggtatcttgagaagccaatggagattgcccggattgtggcccggtgcctgtgggaagaatcacgccttctacagactgcagccactgcggcccaggtgagacctgagacaaaacaaatccctggtctgggaggaatggaaaatcaaacaactttataatgagataaattattagatctactaaaaaagaaggaaaagaaattaaatagatcaataatcataaaaatacattgaaaaactctaaaaaaaaagaaagttccaccccccaaaatacattgaaaaactctaaaaaaaagaaagttccaccaaaagaatccaacagacccaatggtttaaaagttttgttttgttctgacaaattttctttgtttttctttttttttttttctgagacagagttttgctcttgttacccaggctagagtgcaatggcgcgatcttggctcactgcaacctccacctccagggttcaagtgattctcctgcctcagcctcaagagtagctgggattataggcgtgtgccaccacacccagctaattttgtatttttagtagagacggggtttcttcatgttggtcaggctggtctcgaactcctgacctcaggtgatccgcccgcctcagcctcccacagtgctgggattacaggcgtgagccactgtgcccggcctgttctgacaaactttcatagtacagattattccaatatcattcaaacttttccaaagtataggaaaacaagggatgttttcagcttattttatgaggctggaaaaatcctcatatcaaaacctaaaaaacagccaggtgtagtagctcacgcctgtaatcccagcactttgggaggctgagacgggcagattgcctgagcctcaggagttcgagaccagctggggcaatgtagcgagacctcatctctctttttttttttttttgagacagagtctctctctgtcgtccaggctggagtgcagtggtgccatcttagctcactgcaacctccgcctcccaggttcaagcgattctcttgcctcagcctcccgactagctgggactacaggtgtgtgccaccaagcctggctaattttttgtattttttttagtagagatggggtttcaccttgttaggcaggatggtcttgatctcctgacttcatgatccaccggccacagcctcccaaagtgctgggattataggcatgagccaccacgcccagccttttttttttttttgagacagagtcttgctctgttgccaggctggagtgcagtggcgtgatctcagctcactgcaacttctgcctcccaggttcaagctattcccctgcctcagcctcccaagtagctgggactacaggcgcgcgccaccacacccagctaattttttgtgtttttagtagagatggggtttcactgtgttagccaggatggtctcgatctcttgacctcgtgatccgcccgcctcggcctcccaaagtgctgggattacaggcgtgagcaaccgcacctggcttaattaaggatctttctaaacacaagaaagaatatttatcagaaaccaaagggagcatgatgcacagtggtgaaacactattctcagtaaaaacagcaaaagataaggatgtcttttaccattgatacttttctgagggatccagcctatgcaaaaagaaaaagaaatgagggtacaaatattggaaagcaagggacagaactcttattatttacagatagataggtcttcctcgaagatccaagagaaacaaaactaacaataacaattggaactagcaaggtttagaaaggccattgtatacaagataaatatttttagaatctgcagttcccctaatcagtagcagcagtaacctgttagaagatgtaatgaaagtaaagatctgggccaggcacgatgtctcacgcctgtaatccaagcactttgggaggccaaggtgggcagatcatgaggtcaagagattgagaccatcctggccaacatgatgaaaccccatctctactaaaaatacaaaaattagctgggtgtggtggtacgcgcctgtagtcccagctactcgggaagctggggcaggagaatcgcttgaacctgggaggcggaggttgtagtgaaccaagattgcgccactgcactcctgggcgacagagcgagactccgactgaaaaaaaaaaaaaaaaaaaaagaaagatctgattcatagtagtaaaactaaatgtatgcaatttgcatatactattggtatgtatgggaaaatatctggaaacacatatactaaatcattaaagtagtcggtcataggagacttttttactttctgtgaggggttttaccgtctttaatatcctataatcagggacattttttctttttctccgtgaccccctgctttttaaaaaattgtggtgaaatacacataacattacatttcaaatttacctttgtaacctttgttttttttttttttttttgagacagtctcactctgtcacccaggctggagtgcagtggtgtgatcacagctcactgcagcctcaaccacctgggccctagcgatcctcctgcctcagccttatgagtagctgggactacaggcacatgccaccatgcccagctaattttttttttttttttttttggtagagatgggctcttgccatgtttcccaggctggtgttgaactcctgggctcatcaactgatgagaaagagctctccaggcagaaagaagatcatgttcaaagacagaaacagaaatgtgtattcttgggagaagtgtagaaagttcagcatctgattgggtcggggaagacaagctagtcaaggccacatgatgttttaattagtcatgcctaacagtggggccctggaagagcagtttaccacaaggggccaactgcttcggtttgaacccgcagccctgccacttgctctgtaaccttaagtaaacaatttttactctctctgttcctccaatgggagtgataacaataccttcttcatagaattaattcatacatgtaaaatgcttagaacagtatctgacacataaatgcaaaataatttaactgctttctgctgctgctgacatcactatcatcaccctcaccattactgtaggaaatggggacccagtgaagaattttttttttttcttttgagacagagtctcactctgtcacccaggccggagtgcagtgacgcgatttcggcccactgcaacctctgcctctcaggttcaagcgattctcatgtctcagcttcccaagtagctgggattacaggcatgagccaccacactgggctaattttttgtatttttagtgagatagggtttcaccatattggccaggctggtctcaaactcctgacctcaggtgatccatccacctcggcctcccaaagtgctgggattacaggcataagccactgtgtccggccctagtgaggaattttaagcagaaaactgatatgctcaggtgtgagcgaggtggtaggtaacacttactgtgcagtgccctgtagcccaagaggttagcacacaggcatttgctcaggcagcactaggattttctgctgtggaaaacctttgtattttatcctgctccacaagataaaaataagtggtttaagtcaatttggatagaggctccaacttaccatgggaggtaggaaagccaaagttatcccaaggatgttttcaatcgtacggattaggggtctgcaaactgtgagcgtggcccaaatccagcctgctgcttgtttttgtaaatgaggttttttcggaacccagccacactcatttatttatgcattatctgtggctgctttggtgctgcagtggcagggctatttgtggcagggactgtatgacccaggaaaccaaaaatatttaccctctgtcccttagagaaaaagtttgcaacccctgatataaagctataagttggttatttgtggcctcaacccaggcctcactgctattttttctgtttacaatacctggcatgctcttaagtgtctagaattggttaaagatagaagagtggatgtaatccctgctaccaagggctgtcaggctagttgggattataagtacacaaacactcaaagtgagaaaaacacagaaaaggatgtgtgtcattttgtctaaggaagttgaataagatttctcaggaaaagaaacatttgaactgaatttgaaggtgagtgagttcaggtgtgtttgggctgaagcccaggccatgctgagtggatagcgggtgggaagagagtgtggaaacacactgcatgcagggaagagttgggagtctggggtgaccaaggcacagggagggaaagttgaagttatcaattgtgtgaaacagctttctgtgttggcctgagatgtttatagctggaagcagtggggagccaatacagttttttacgaaggtattagaggtgggtttctgtgggtgatcgttaatcatgttttctccctttaagtgtagtcctgcttgagaaatagacatgagaaaggaatgaaggttaaaacatcagctgtattgttggtaaaactagaatggaaagtgtggcttgagctggtaaccataggggctttccaatgcctgtgccctgagttagatcttggggtagagagactggatgtgcagagcagcacccccaccccaccccagccatccatatggagcttcagctgccatagaccaacaaggcagagggataggcctctagacctgcttctagaaaccaggctgctgctcttgcttatggtgggccctaggaaggcaagagtgagaggagggaggcaccagcttaggtgctgggttctttgaagatctgtgtgtacacagagtctttctctccatcttaccaatcagatgagtcactgtcactgtgggaagaagtaggggcatgggtcaccttcccaaaacttctaagaagtttgtattctgtgggcttggatagggaccatgggaaaggaagagaatggttgcccataaaactggctgtagtgtggcctcaaacttctggacttaaatgatcctcccacctcagcctcccaagtagctagaactacaggtatatgccaccatgcccagctagttaaaaaaaaatttttttttttttttggttgagatgaggtctctttctatgttccctgggccggtctcaaactcccagcctcaagtgatcctcctgccttggtttcccaaagtgctaggattataggtgggagctaccatgcctagcccaagcctgtaattttttttttttttttttgagatggagtttcacttttgttgctcaggctggagtgcatggcgcagtcttggctcaccacaacctccacctcccgggttcaggcgattctccttcctcagcctcccgagtagctgggattacaggcatgcaccaccaagctcagctaactttgtatttttagtagagatgggtttctccgtgtcggtcaggctggtctcaaactcctgacctcaggtaatctgcccaccttggcctcccaaagtgctgggattacaggcatcagccaccgcacctggcacgaacctgtaatttttaagtttcatatgctatttattttttgttatttctttaattcattcattcatttattcattcgagatggggcctcactatgttgactaggctagttttgaactcctggcctcaagcagtcctcccacttcagccttcccaagtgctgatattataggtgtgagctgctacatccagccttctttcttctttttctttttccatgtgctatttgacattttccaaggtaccagcctccccttctccccaagataatatcttttaatatggaatttcatccctagggcaggactttttttttattatccctcagaaatatactggacaccacgtttaagtagacatccaacatctgctgtcataaattgttttgaattttttgacatacttgcccatgaggtttttgaaggcatagaccatgtcttagctgaacatgtggtctcttagtgccataaagggggtttatggtatgacctgtgtagtgtcacctgtgtagtgacagcaccactgcctctgtttcccttcctcttgtgatggcagcagcgtctcaagccaaacaagaagggtagttagggtgggatggaagctgggtagaggtattcctctccccatagttctgtgttcacatgtgcattgacctcctttttggcagcaagggggccaggccaaccaccccacagcagccgtggtgacggagaagcagcagatgctggagcagcaccttcaggatgtccggaagagagtgcaggtgatgcaagttacaagcctcgggcagggagctttcattaatttttttttttttttttgagacagggtcttgctctgccactcaggctgggctgcagtggcatgatcacagctcactgcagcctcgacctctcaggcccaagcgatcctcctacctcatcctcccaagtagccgggaccacaggcatgcaccaccacgcccagctaattaaaaaaaaaaaatttgtagagatgggggtctccctgtgttgtccaggctgatcatgaactcctgggctcaagtgatcctcccaactcagcctctcaaagtgctggcattacaggcgtgagccactgcacctggccaacagggagccttctcttggggatactgcctgcaggtcctgcatgtatcttttttgaggttttggcttcatttgaattctcctcagaaactttatattttctgttcccaaggaaatctttctttacttctgtttttttgtttgcttattttaaacaggatctagaacagaaaatgaaagtggtagagaatctccaggatgactttgatttcaactataaaaccctcaagagtcaaggaggcaagtgaatattagagatgttaaaatctctagaaagtgagtttgtgttgttgagttgaaagactcatttgtcttaactctgtttagatcttaaggcgggcggggcgcaagggaggtacgggtcctcaaaggagcctggtcattaaggacaggagtattccctcaggtccaggagtattccctcaggtccaggagtattccctcaggtcaaggagtattccctcaggtcaaggagtattccctcaggtccaggagtattccctcaggtccaggagtattccctcaggtccaggagtattccctcaggtccaggagtattccctcaggtccaggagtattccctcaggtcaaggagtattccctcaggtccaggagtattccctcaggtccaggagtattccctcaggtccaggagtattccctcaggtccaggagtattccctcaggtccaggagtattccctcaggtcaaggagtattccctcaggtccaggagtattccctcaggtccaggagtattccctcaggtccaggagtattccctcaggtcaaggagtattccctcaggtccaggagtattccctcaggtccaggagtattccctcaggtccaggagtattccctcaggtccaggagtattccctcaggtccaggagtattccctcaggtccaggagtattccctcaggtccaggagtattccctcaggtccaggagtattccctcaggtcaaggagtattccctcaggtccaggagtattccctcaggtccaggagtattccctcaggtccaggagtattccctcaggtcaaggagtattccctcaggtcaaggagtattccctcaggtcaaggagttttttcttccttcgcagacatgcaagatctgaatggaaacaaccagtcagtgaccaggcagaagatgcagcagctggaacagatgctcactgcgctggaccagatgcggagagtaagggcataggtcggaccacttcccccatgtgtctcgctcacttgcgggatttcagcgtcttgtggcagaacttgcttggtttctaagaagttcctgctctggagttgactaaagaatgtggttagagacagtctgaggaaatgttttctgactttgttttggtttccaaccagagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggtaaaggatgaaagaagcttttcctttctttctcgaaagctagattgaattctgatcttaactgcaggcccacagaattggtactatatctccaacgtggggacttttccatattcaaatttagcccaagaattaaagtttttactttatttcggccaggcgctgtggctcacacctgtaatcccagcactttgggagaccaagatgggcggatcacttgaggtcaggagtttgagaccagcctggccaacatggtgaaaacacatctctactaaaaacataaaaaaattagccgggcgtggtggtgcgcacctgtagtcccagctactctgggcggctgaggcaggagaatcacttgaacctgggatatggaagttgcagtgagcggagatcttactaccgcacaccaaccagcctgggagacagagtgagactccatctcaaaaaaataaaaataaaataaagtttttactttatttggagaaactttgttttaaaaaatgtatttatattattatattttaagtatattttacttaataattcaattaaggcttttggtttaactgtatttaacagatagacaaaccttttaattttagttattttagtaatctaaaatgacacatgccctttttaagggaaaaaattcaaatacagaaaattaatcaagagaagaaaaaatttttaaatgaaatcatcagcagtactagtagttaaaatttagttgatgctcaatctagacatctgtcattatgtatatacacattatgtatatacacataaagatagaaatttatacagtttatattaggatcatttttttttctttttttggagtcagggtctcactgtgttacccagtctagagtacagttatgcagtcatggctcactggagccttgacctcctgggctcaggcagtcttcccaccttagccttctcagtagctgggactacaggcatgcaccaccacacctggctaatttttaaattttttatagagacagggtcttactttgttgcctgggctggtctcaaattcctgggctcaagggatcatcccacttcggcctctcaaaagctctggaattatagatgtgagctgccgtgcccagcccaggatcttcctttatatgcttttctgtaatttgcacttttaccttcatccagcatatcttactgcaacccttcctgtgcaaggccctatagtgagcatgttgcaccagcttgccttaggagaaacttgagatacagagcctgcactggaaatttagcgcaactctacatgagaatgcctgtctattcatatcctcactaaccctgagtgttgttaatttactgaaagcagttttaaatgcttcctgaccagggaacgaagaagcttaagttctgggaatgggaggatagaagtgccagaaaagagctcaggagttcagaaatccctgcagcggtccccctccctctcctttcactttctgtctttctggtcttttggtctttgttacactagtgataaaccatcaaagaatgatggaatgatgctaacttctctctttttttaatttttttgagacagagtctcactctgtcacccaggttagagtgcagtggcatgatcttggcttactgcaacctcctcctcccaggttcaagcgattcttagtcacaaccttccaagtagctgggattacaggcccatgccaccatgcctggctatttttttgtattttagtagatcgacctgcctcggcctctcaaatttttgggattacaggtgtcagccactgcacctggcctaatatctctattcttggagatagatttaatgagctttttctccctctctattcacttattccttgtgcatgttatcaatattttgaaacataatgtcatgtcctttgatcagttgaaggctgacattgaaaaggcttatggggattgggtgttgtggctcacgcctgtaaatcccaatgctttgggaggcagagtcgggaggatcacttgaacccaggagtttgagaccagcctgggcaacaaagtgagatcccatccctacaaaaatttaaaaaactagacatgtgccattacacttcagcctgggtgacagagtgagactccatctcaaaaaactaaactaaactaaacaggcatggtggcacacacctatagttctagctactcaggaagctgaggtaggaggatcactcatgtccaggagttggaggaggcagtgagctatgatcatgccattgcactgcactaggccacagagtgggaccctgtctcaaaaaaaaaaaaagaaagaaagaaaagaaagggctcatgtagttcaagcccttctcttcatgcaaggggatgctaaggcccatgatggtgaagggcctggcaaagcttgcacagatagtgtgtgacagagctggctcaaacccatctttgggagctgtctaatctctttttctgagtctttatgttcatagacaagttaggatgagtaaagtaagtgctaaattccatatttcgtgttctgcatatctgggctcagatgcttgtcattttccagtgataactccatcaatgcctcctagtggtataaattttaatacttcttgtgtgcccagccccctcttagaaatttgagattttaggaagggactagtaataaaaggtaaaataaattattttctggccaggcatggtggctcacacctgtaatgccagtacttcgggaggtcgaggcagatggatcacctgaggtcaggagttcaagaccagcctggccaacaaggcaaaatcccatctctactaaaaatgcaaaaattatccgggagtggtggtgggtgcctgtaatcccagctacttgggaggctgaggcaggagaatcacttgaacttgggaggcggaggttgcagtgagctgagactgtgccactgcactccagcctgggcaacagagtaagactctatctcaaaaaaaaaaaaaaaaaaaaaaaggccaggcgcagtggcttacacctgtaatctctcaggaggctcaggcaggagaatcacttgaacccgggaaatggaggttgcagtgagccgagattgcaccactgcactccagctcaaaaaataaataaataaataaattattttctttttttatttattttttcagcatccacccaacatggtgaaaaattcctcttttcttaatgtcactgaactgtaaacttaagatgaaaaattgtaaatttcatgctatatatatttcaccacaataaaaaaattccttgttcttattgtagtggtctccatgtcttcagtatttccttccccttctccatctcacctgtatacattcactttggtaattagcatctttcttaatttattggcaggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaaggtaatttagcatccttgtccctttccctcatctaaaaaatacctaaagactcacgtggtagagtgagaggcgggctgacttctggtcatggccgtggcgcgtgagcccatcttctctttcctcagtgcctttgtggtggagcggcagccctgcatgcccatgcatcctgaccggcccctcgtcatcaagaccggcgtccagttcactactaaagtcaggtaggccatgccacttccatttccagtagagattttactgagggacactgttagggtgagggtagagttggtggccagggtcattctttccaggtgtggtgtcacaggcagtacactgttgcggggttgaaatttgttgccatactatctgcttgctctctgattctgatgtcaaaagcaaaagagcagtcatctttttgaaggtacctgggcatattcctatgattgtagacctggagtctcaggccacagcttctccttctgcccaagggacaaaataatgtcatctattttctgttctttgaggctactcttccctgtggattttaagggaaagagtaaggcttagtgatggggaagctgagaggccccagggcaggtgggtggtgggcctgtagggtgaggtgttactttcacactcaagtcagaacaggtgtgctggggttttgaccttctgcagcaaaatttccctcctcagaaacttagtatggtgttcggtttcaggattaatagaacaaaatgccagctgcacagcatgtgttcctgtaatatttttcattatatggctttgattatccttttgtgaatctctcacaactttaagttgttagttcttagatgttttctcagtacctttggcttgaaggagtgatactcatcttttgtttttgtttgagacagggtctcactctcacccaggctggtgtgcagtggcatgatctcagctcactgcaacctccatctcccaggttcaagtgattcttgtgcctcagcctcctgagtaactgggaatagaggtgcgtgccaccacacccggctaatttttttttttttgagacagagtctcgctctttcggccaggccagagtgcgtgttgcaatctcaactcactgcaacctccacctcccaggttcaagcgattctcctgccttagcctccctgagtagctggaccggcacactccaccatgcccggctaatttttgtatttttagtagagacagggtttctccatgttggccaggctggtctcaaaactcctgacctcagtaatccacccaccccggcctccaaaagtgctgggattacagatgtgagccaccacgctcggcctttttttttttttttttttttttgagatggagtctttctctatcacccaggctagagtgctgaggtgtgatctcggatcactgcagcctctgcctcctgggttcaagtgattctcctgcctcagcctcccaagtagctgggattacaggtacctgccaccatgcccggctgatttttgtatttttagtagagacggggtttcaccatcttggccaggctggtctcgaactcctgaccttgtgatccacctgccttggcctcccaaagtgctgggattacaggtgtgagtcaccgcacccagccctattttaatttttttaaagagagagataggggccaggcacggtggctctcgcctgtaatcccagcactttgggaggccaaggtgggtggatcacctgaggtcgggagttcgagaccatcctgaccaacatggagaaactctgtctctactaaaaatacaaaattagctgagcgtggtggcgcgcgcctgtaatcccagctacttgagaggctgaggcaggagaatcacttgaacccaggaggcggaggttgcggtgaacggagattgcgccattgcactccagcctgggtaacgagagaaactgtctcaaaaaaaaaaaaagagaaagagagataggatctcgctctgtcatctaggctagagtgcagtggcatgatcatagatcactgtagccttgaactcctgggcacaagtgatcctcttgcctcagcctcccgagtaactgcgactacaggtacatgctaccacaccccgctaatttttaaattttttatagatgtgggctctcactttgttgcccagactgttatggaactcctgggctcaagggatcctcccagcttggcctcccacagtgctgagattatagatgtgagcctgtaattatagacagcttggcctatttacctgttggaaatgaagaattatgaattttacatttcttcaagaaaaggttatgggagagttactgactttttttccttggattttttctttttaaataggttgctggtcaaattccctgagttgaattatcagcttaaaattaaagtgtgcattgacaagtaagtactcctatcttagctctgtttttcaaatgaggaatagaaaaatgagaactttgacagacatcatttgaactagagactctgtctttattcagagatcttcattttgtggacaaaagttttcaaaagccttggggtgcattgtcatttacgtgtctgaacaaagccacaaagctgggggtacagatttgatttgtggttgctattgtgacaaccagtccctcttttccttgtttagttttttacttgtacatgtcattcatgcatattatatataagactgagatcatgtgttaattaacgactgggatacgttctgcaaaatgtatcattaggcaattttgttgtgcaaatgttgtagagtatatagtccttacacaaacctgggtggcagaacctactgcacacctacgctatgtggcagagcctactggtcgtaggctgtaaacctgtacagtatgttactgtgctgaataccgtaggcaattgtaacacatctcaatgaagtaggaatttttcagctccatgataatcttatgggaccaccatcatatatgcattttgttgttgaccgaaacgtcgttatatattctttccatacatagcatgtggaaagaatagatctcttttttttaattgttccacactttaccatataatggaatacgcaaaatttcacaatacctttcaggatgtaaaatacatataccctttgacgacattagaaaagagaaaatgtgggccgggcgcggtggctcatgcctgtaatcccagcactttgggaggccgaggcgggcggatcacgaggtcaggagatcgagaccatcctgggtaacacggtgaaaccccgtctctactaaaaatacaaaaaaactagctgggcgtggtggcgggcacctgtagtcccagctactcaggaggctgaggcaggagaatggcatgaacctgggaggtggagtttgcagtgagccaagatcacaccactgcactccagcctgggcgacagagactccatctcaaaaaaaaaaaaaaagaaaagaaaagagaaaatgtggctgggcgcggtggctcacgcctgtaatctcagcactttgggaggctgaggtgggcagatcacctgaggtcgagagttcgaaaccagcccgaccaacatggagaaaccttgtctctactaaaaatacaaaattagccaggtgtgttggcgcatgcccgtaatcccagctacacgggaggctgaggcaggagaatcacttgaactcaggaggtggaggttgtggtgagccgagatcacaccattgcactccagcctgggcaacaagagcgaaactatctcaaaaaaaaaaaaagaaaaaagaaaagataaaatgcattcttatttttagttgatgtaattatgtggaaatttcatgaggatgcactggaaaataatgaaataagggagttgacgaaggtggtaggtttaataagtacatatgcaatatgaaacataggttccccttcctatggggaggcaaccaactgtgcctgctacgcagaggtgttatgttgcgctgatcaactgtaactgaatagtttaaagaaatgcccaggagcacagaggttttttcatgacagtaaataacaggtggtcaaagtaggctttttgaagaaacacagagcctattttattaacaacagtctgtgttcttacagagactctggggacgttgcagctctcagagggtaagttcagcctagaggcttccttttgttccgtttaacctaacttcatcctccggctacttggtcacctacatagttgattgttcccctgtgattcagatcccggaaatttaacattctgggcacaaacacaaaagtgatgaacatggaagaatccaacaacggcagcctctctgcagaattcaaacacttggtatgtgggaggagctccccttcacaaagggcctctggctgccggagagggctagggagagcctcacaggacacctgcctttttcttttcttacagaccctgagggagcagagatgtgggaatgggggccgagccaattgtgatgtaagttttgttggggatgaaagacaactggggtgttttccttgagggagagaggggtaaagatccttcttaatccccagaattagaaacatcaacctgttctttcagctgtagttattccaaaaagtcacttcaggccaaagtgacatgaacagaagttccatgtgccatggagctctctggcttggaacatttccgtgaatatctgggagttggctcctccttaaggagaagtggaaagtcccttgctgagttgttctccacacccatgtggtataaagcagctttccaccttgcctggggctttccaaattccccatccagctcctgcggctgaccctgcttggctccatttttagtgccctgtttttctctcccactgaggtgggatagagggtgtaaaagcaacagatttgagttaaactttaaaataaatgaccaccttgcattagcttgcttaggaaaagagtacataaaataaaatgaacaaacaaaaacccatcttgttctttatcccccttattttctgcttttcattgattcagattattggattcttattgtcaagaataaactttaaacaaacaaacaaaaaaaggtaaatgtgacggaaggctagttttcagtcatttttaaaaattgtgatgccccgttctttttcttacatttgtcccctgaacaattcttcctctttaaaatgtagcagtcctagctgggcgtgctggctcacaccccgtactttgggatgccaaggcaggctggtcacttgaggtcaggagttcaagaccagcctggccaacatggtgaaagcccgtctctactaaagatacaaaaattagctgggtgtggtggtgcacgcctgtagtcccagttactggggaggctgaggcatgagaatcgcttgaacctgagaggtggagcttgcagtgagccaagattttgccactgcactctagcctgggcaacagagtgaaactctgtctcaaaaaaataaataaaataaaatgtagcagtcctttttaaaaatgtggaattttacttgacagtagagtgaagtagcctgtatgcaatgatatgggaaaatgtacatgacatattaagaaaaagcaaaatgtaaaataatttgaatagtattattagtatatgtgttttaaaaatacactatactcttatgtgtattcatatgtatattaagaaattctggaggaatataccagcagtgctatgtgtattagtgctgctgttggtatccatggctattctagactgtctctgtgatatttgcattttaaactgaatatattacttttataatcagaaaaatagtattaaaaatgaattataatttaatttcttttttcttttttttttttgagtcggagtctcgttctatcggattgcagtggtgcgatctcagctcactgcaacctctgcctcctaggttcaagcgattctcctgtctcagcctcccaagtagctgggacgataggtgcatgccaccacgcctggctaatttttgcatttttagtagagacagggtttcaccatattggtcaggctggtcttgaactcctgacctcgtgatccacccatctcggcctccgaaagtgctgggattacaggcatgagccgctgtgcccagactagaattcaatttttgagaattcattgacaactcttacttaaaataaggttgctgtactgatgtgagacattgttgtagtcagtttggaaaacaatttggcagtataaaaatgaacatacctgtaaaccaacggtgccattcccaggatttaatagcagagaaatctttgcatatatgtcccaggagacatatataaagtggacatcagcctgattataagctctaaatgcaacccaaataaatacccatcaacattagaatgaatacattatttgtggtatagacacaatggaatactccgcagctgtgaaaaggaatacactgcagatacacataaccatgtggattcatttcacatcaagtgaaaagtgaatcccaaaagaattcattggagtccataagtgtaaggttcacaaatgtcccaaactaaacaatacctgcattgcttagataaacaaatatggtaaaactgtaaaaaaacaaaacaaaacaagacaaaaagggctaggaaatgataaacccaaaagacaaaatagcagttatttctgagggaggagggaaggggatggggttggggaagggcacccagagaattttaggagtgatggacttttccttaaattgaatggtgggttcatattgttttgttattctttgtgccttacgtattttacaaataaccaattggatctatgtaatattataatacaaactgagtaaaggattaggttgaggatcacagcattggaagttcttggtgttgaagagagtaagtgccgagcaagttgtgtccctggcagtttgtttgtgaccacctggtggcttacccttcttggtgtggtgaggcttggcatgtcactttccttggctgtggctgttagtactgaatgccattctctctgaggaaaagtgtccttctcttttttattgattgactgattgattgagacagagtctcactctgtcacccaggctggagtgcagtggcgtgatctcggctcactgcatcctctgcctcctgggttcaagcgattctcctgcctcagcctcctgagtagctgggactacaggcgcccactaccacacccagctaatttttgtattcttagtagaaacggggtttcaccaaattattggccaggctggtctcgaactcctgaccatgtgatccacctgcctcggcctcccaaaatgctgggattgtaggtgtgagccatcacgctcagcctttttttttatttaatttaatttttttttaagacagggtctcactctgtcaccccagctagagtgcagtggcacaatcatagctcgctgcagcctccatctcctaggctcaagccatcctcccacctcagcctctcgagtagctggggctataggtgtgcaccaccacacccagctaatttttgtattttttgcagagatggagttttgctgtgctgcttagactggtctcgaactcctgggctcaggcaatcctcctgccttggcctcccaaagtgctgggattacaggcatgagccaccacacctggcctaagagtgtccttctcgttactgtaggcttccctgattgtgactgaggagctgcacctgatcacctttgagaccgaggtgtatcaccaaggcctcaagattgacctagaggtaagttctgcagcagaatcggtgagaggctacgtacaggggtgactcaggacaaaaacttccactgggatttttacaagagaaggtggaatgattactgtttgcttaacactgtgtttatttttgcttacttttctccaaaaaaatccttggcatcccatctggcaataaagtcttgcttgaatgcttagaagatgtgtgtatattcagctttcagcaaacttgatatgaaaatctctatttagaaattgattggccgggcgcggtggctcacgcctgtaatcccagcactttgggaggctgaggcgggtggatcacgaggtcaggagttcgagaccagcctggccaacatgacgaaaccccgtctctactaaaatacaaaaattagctgggtatggtggcggacgcctataatcccagctactcgggaggctgaggcaggagaatcacttgaacctgggaggcagaggttgcagtgagctgagattgtgccattgcactccagcctgggtgacagagtgagactccgtctcaaaaaaaaaaaaaagaaattagaactgactttataaagtttgggcataagagtcttagcagccagtgtgtttagtatacagaaaattgtggcaatgacattctcctttcccaactttcttgatttttaaattaagatatacctagaaaagcaggaatcctggtctttgattcctgagacctccctgtttcatgtgaagatacagcttcaagtcttggagaatgcctccaaggtcttaaaaatggggaatctgtggattgtgagtcaagctttgagcaagtcaggttttacaagggaccggtatattccgactgcagcctgagttgtgtggccacgctgggcattctttccactatgagtgctcactgagctgactcactcacactcctcgcctagagttggcagcaggtgtggtttatggcatgtcctttcattctgagccccgtgagatgcgggtgaagagatttccaaggctgtgagagcccctctgcctccccagctcagtccccactccctccgcagacccactccttgccagttgtggtgatctccaacatctgtcagatgccaaatgcctgggcgtccatcctgtggtacaacatgctgaccaacaatcccaaggttagtgccccctccttttagttggtgccccgggatctcttgcgacttaggggtacctagtatagacaatgagcaccatccctcatctaaacaagcaaatgtgttctttccaatagaatgtaaacttttttaccaagcccccaattggaacctgggatcaagtggccgaggtcctgagctggcagttctcctccaccaccaagcgaggactgagcatcgagcagctgactacactggcagagaaactcttgggtccgcatttcaccccttctccctcccgcccacccgcccagaaaagggatccggcccatagggctgttcatttgggccatgtctactgagcattaggccatgtttctttcctgagcaaggcgctgtgctggtgccaggaaacaggggagttggggagttggggtgcagagacagtttgcagttttcagtcgaggtgatcatttttgaggtgggaggtagatttcttttctcctggttgctgtctcattcacccactctatctaactttagaagatcttttaagtgtgtgttggaaggtggcactaaaggcttgacattccctgtccatttttttaataaactataggctagttggttttttttgtcttattttatttatttatttatttttttgagacgagtcttgctctgttgcccaggctggagtgcagtagtgtgatctcggctcactgcaacctccgccttctgggttcaagcgattcttctgcctcggcctcccgagtagctgagactacaggtgctcaccaccacgcccagctaatttttgtatttttagtagagacggggttttaccatgttggccaggatagtctccgtctcttcacctcgtgatccgcccacctcggcctcctaaagtgctgggattacaggcttgagccactgtgcccagcgtaggctagtttttaaaaaagaattagtggaatattttatgtgccacctgggctagaagtagctttgttctaataaagctgttgccaccaaatacacctgtctgacacccgatgtcagcttgttagtgagtgctgctgttggttcccagcctaccacccgaggttgggaagagcagggggacttgttatatcaccctccatccctgctgggctacccagcaacacaagtgagtcaaatgatgggatagtgtttgtcctcatgtgcacacacacaacagtgcctaccttcaaagatgtgaaagctgattattttgtggcccattgtgggatgaatgtgtgtgtgttctgttttaagaaataacctcttgaccccaagctgaaaatgtactacttgactctttttctttccttcaggacctggtgtgaattattcagggtgtcagatcacatgggctaaattttgcaaagtaagcaatcttgttaaattctcgtgggaatgggaatgctcacctgcacggctgtcgttgagggctctggcttgaaggccctgaactcttggtccagcggccagtaggacctgcctgaaggtagacgggcctgaggatttgggtgatgcactgcacccctaggaagggaagggctgggatggcagtagacttggctttcccattactcttttctccaggaaaacatggctggcaagggcttctccttctgggtctggctggacaatatcattgaccttgtgaaaaagtacatcctggccctttggaacgaagggtaggttggacagagtgtgcacagatgtaaccaagtcccctgctctcagcaagccagtggcaggggatggatgccctgttagcaataacaacattgttcctcctccttggctccaggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagggaggctcccacccaccccacctgctggtggctgctgaggcctcatcactgcttctagttgcaagcacctactgccccctggtgggtggagatggccttgactccctgtttcactcagactcgcaaaacacatttgcgtgacttctaaatccttccagctgaaggattggtttgctttgttttgcttgctccagtgactatttgttgagaattttgcaatttaaattgtattcttcatctctttttctacttaaccctgttaatatatcttacgcaagtagttatattcaagtttattttctatgacccaactagtagcctcttcttaattagaagccagcctgaatatttccacagtgccaggccactgaacagggtgttcagggtctcaacactagggtggcttaagtcttttccccttcgaggaaagaaaaaatgggcagttttctctgagatgacctagctgtaggttccatgatctttccttcccatgtcctgtgacaggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagttgttgattttccatgttcctggcatttaatttttgggaaaagttggaaattttgggatccttggaggatagataggcaaatgcctgaataacctgggggataattatttctccttatgggaaagaattgtagtgagtgcttttgttggggtgaccgatgggatttgagaggagaatcagaatcacttagagtagtgtagttcctgctccacagagagtgcatgagtctaaagaggggatacagcctgggcaatatggtgaaacctcgtctctacaaaaaatccaaaaaaattacccggtgtggtggcacgcatttgtagtcgtagctacttgggaggctgaggtgggaggatcacctgagccaaggagttcaaggctgtagtgagcggtgatcatgccaccgcactccagcctggctgatagagtgagatactgtgtcaaaaaataaaaataaagaggggatcaatacacatacgtcccccaaaacatgcctgaaacacgagaagggaaagtgagggcagttaacaggatgccctgctggcacagtgcttcttagtagatgctagaaggtttgaggcccagatttcagcccagcatatggctttttgcctgtaactgaaccatgtcagtgtgccagatggtctgaagaaagggtttctggaggaaattattattagctgcatgggagtatggtttacactagagtagaagagctgggagcatcacgtttgaaggggaagacagtgactgggtggaggggcaagggattagtatttagagtgtgcaactattgaaaataaggtatattttaatgtgtaagaggacatgtacttatatgttatatataaattattttagctgggtgaagtggctcatgcctatagtcctagcactttgggaggcccaggcgggaggatcacttgagcctgggagtttgagaacagcctagacaacatagtgagaccctatctatacaaaaataattttttttaaattagccacgtgtggtggtttgtgcctgtagtcctagctactcgggaggctgaggtgggaggattgcttaagcccaggaggttgaggctgcagtgagccatgatcgcaccactgcactccagcctgggtgacagagcaagaccttgactcaccaaaaaaaaaaaaaaaaaaaagagagagaaattaaaaatactgtaatctcagctgggcatgggggttcacacctgcagtcctagcactttgggaggctgaagcaggaggatcacttgaggccaggaactcaagaccagcctggcaacatagcaagaccccactacacacacacacacacacacacacaaagaagagaaagaaaaaaacgaaacaaaactgtaatctctgcagctgtcctcagtgtggagggggtagccctgtctgttccccttcagcacttgctgttttgactctctgggttctttgtgcaggtcttgatggggagtctctggtttgccattctttgtttgatttaactttctgtaatcataaagccaatgatgggctttttttttttttttttttttagactaagtcttgctctatcacccaagctggagtgcagtggcaccatctcggctcactgcaacctccacctcccggttcaagcaattctcctgcctcagcctcccgagtagctgggattatgggcttgtgccaccatgcccagctgatttttgtattttttgtagagaaagggtttcgccatgttggccaggctggcctcgaactcctgacctcaggtgatctgcccacttcagcctcccaaagtgctgggattacaggcgtgagccactgtgcctggcctaatgatgggctctttaatgtgatcctttagggttggcgccttgccctagttgctgttgaaaaaactatttttgtccaaatagcacacacacagaaacctaccaacttccctcccactttttcctaggaattccttctgagggatttcttgagatggggcagaatggggcttggaagagggagttggagctaattgaccgttgcctttctcctttgttggggtcctgagtcttgttcctgctgtaagagttactcacttcctgtctgccacctatctccctttgcatgtgtgcttcagttgggagatctgtttatcagcccctgccacacggctctttgttccttctgcagaggacgttggggtcccacggctggtccttttgactcattttgctttcaaggtcccacctcccagtctgaggctgcatcctccattaccatcgcccttcctgtgggctgggaggccaggtcctttcctgcccagcgatgtcagcgtttcctcaggggccaggcactcatcaggagaaaggaactaattacttgagtaatttgccttgccttgctgagaggagtgtgccctgagggactccatgtgagtgtggtgacgggtgtgggggtgtccctgtgttattttaaaatgggtgccttcaggacgatgagcatgtgaccatttcctctctatttccatcacaagagtattatggtatgagggtctcaggttagattatcctcccaagactcttctctcttccttctctactggaagcccacatagcatttccttatggcttgagggagaggttcggagccacttacaaattagataaagtacatttacaatcttgtacaaagccacacaatgaagtcatttttctcagctttttttttttttttttttttttttttgagcctgagtctcgctctatcgtccagactggagtgcagtggcgcgatcttgcttcactgaaacctctgcctcccaggttcaagagattctcatacctcagcctcctgagtagctgggattacagacatgcaccactatgcctggctaatttttggatttttagtagagaccgggtttcaccctgttggccaggctggtctcgaacccctgacctcaagtgatcttcccgcctgggcctcccaaagtgctgggattataggtgtgagccacagtgcccagccttgtttttgtttttgttttgttttgacagtctgtcactctgtcacccaggctggagtgcagtggtgcgatctcacctcacttcagcctctgcctcccaggttcaagtgattctcctgtctcagcctcctgagtagctgggattacaggcgtgccaccacgcccagctatttttgtaatttcattaaagacagggtttccccatgttggtgaggctggtcttgaactcctggcctcaagtgatccacctgcttcagcctcccaaagtgcagggattacaggcatgagccactgtgcctggcctcagctatcttgaatgctggagaattaaatccttttctgtctagggtgtcagctccctaagggctgggccaaaacagttggatttataagacactagagtcttgcctcagtagctcctttgaattctgcactgaattgatcagtttcttggcccaaagtaaactcagatggcagcccaagagccactctgcagtgccttctttcacatggtcatcatgctctctgatccctcaggttctgtctaagcctcatgttttatgaccgtgctgttctcagcccacctcaccctgccccatgccttctcaatggtttgttcacctgaattccccagatttcatgccagtatccccaaggttccttgacctcttggtgtaagcattcagcatctaaaattcattttattcccgtcaacgcatttctaactgtagaacaagaattataaatgacaaagctcatagaaaattggcaccttgtcttccccctccctcttattttatacataaaagagaatatgggctgggcattgtggccaaggctgggcatgatagctcatacttgtaatccagcactttgggagggtgaggcagatggatcacctgaggtcaggagttcaagaccagcctggccaacatggtgaaacctcatctctactaaaattacaaaaaaaaaattagctaggcatggtggcagatgcctgtaatccagctactcaggaggctgatgaaggagaatcacttgaaccctggaggcagaggttgtagagagccaagatggcgctactgcactccaacctgggcgaaagagagcaagactccgtctcaaaaaaaaaaaagacaaaaattagccaggcatggtggtgccacctgtagtcccagctgcttgggagcctaaggcaggagaatcgttttgacctgggagtaggaggttgcggtaaccgagattgtgccactgcacttgagcctgggcaacagagtgagactctgtctcaaaacaataagaacaacagcaacaaaagagagagaccatgccttgctccaggtctcttagctattgaagatgtacctggacccaggtctccggtcttctagttgaagcaattgtactgccttacaaagtcacattctctttggtgctttttgattgacgtatttatccaactagaaagttactcatgccctcatccaaaaatgtggtagaggccagattagtgctggtaggaataagagatataacctttggctttggaaccacaagcattagcagtctccatgttctttaaagacttggtgatattggtatttaggctggacaccatgcaaagactacacaggctcggttcctgcatgcagagaagttatctaagagatatgaccaggccggaatagaatgctcagaccacgtggaggctgttaaacttttacataatctagggaaagaagggacacaaggtggcattagtctagggtcaggtgggaaaaggttatgctgaaaagtctctgcagctcaggacagctttgtgcaaagaactgaagttcacagctgctagtgcctgggagatcaaatagtataaatgagggcagacaaccctgaggggcagatggagctttccagacaatcttggcatgaggatgagtgagtttcaaatcagtcctgccgaggcagatggcttcctccagctctgcttactgaatgcgaagtcacagtcagtaagaaaactggttttcttcttcccaggcgctgccccatacctgaagaccaagtttatctgtgtgacaccgtaagtggcttcctttccccgttttgccttcatttctaatatcctcagttatccctgggaatgggacactgggtgagagttaatctgccaaaggttggaagcccctgggctatgtttagtactcaaagtgaccttgtgtgtttaaaaagcttgagcttttatttttctgttggagaccagagtttgatggcttgtgtgtgtgtgttttgttcttttttttttttccattgtgtcttgtcaaccccccgtttcccctcctgctgccccccatttcctacagaacgacctgcagcaataccattgacctgccgatgtccccccgcactttagattcattgatgcagtttggaaataatggtgaaggtgctgaaccctcagcaggagggcagtttggtgagtatttggttgacagactttgtccctataagggaagttggtcccctttgtgtgatgctctcacatgtacacaccgagagctggtcactcggaatggtaggagattctagagctttgctttccaaaagagatggtatgaatgccacatgtgtgagtataaatcttctagcagccacactggaaatagacgaacttaatttttacaatatattttatttaacccactaaatccaacatactctcaatttaacatttcagaaaaagttgaggctgggtgagtggctcatgcctgtaatcccagcactttgggaggccgaggtgggtggatcacttgaggtcaggagttcgagaccagtctgaccaaaatctctaaaatataaaaattagctgggcatggtggcgcatacctgtaatcccagctactcaagaagctgaggtgggaggatcgcttgagcctgggaggtggaggttgcagtgagcagagatcgtgccactgcactccagcctgggcgacagagtgagactccatctcaaataaacaaaactaaactaaaaagaaaaagttgagacctttttttattcttttttttcatactaagcctttaaaatccagtgggcttttgacagccacagcacagctcagtttggacaaaccaaatctcaaatgcttggtggccacgtgtgtctcggggctcctgaattaaacagtagatcaagggcagaagatctcaggacagccttagagcttctgtaaacatggagctctgggaatcagttaaggtgggaatgagaaaggacccttcccgaggcagggtcctccagggaggagggtaaatctggcttttctgaccatccctgggccttaaggggcaggagattggatagcagtggtagcctgggccctgtcctctgaagggctgggggcgtggcctgccagttgcagagggtggacaactgaactagttttccctgtctgtccctccagagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtctgatagcatggcagctctgtttggctggtggaggcttccttttcccctgcataagttctgagggggcctcacacacaggtggggcctgggataagggccggaaagggtcttgagaggaggtggttgccttaatcccccccgccaacccccttatgttagccaccagcccggaggtaaggggtgcctggaggagcaggaggtcaatagtccaacggcagaaaggtgtcagagtggaggcctccctccccggccccctcctaccccccagagcggcctcgtcctgtctggggtcagataagccacctaagcggggtggggggtagatactcccaccgcaccaaggcctccccttccacagttggctcctttatcactttcccttcagttcacccagcggggacaacacgcagacacccggtggtggctgcagggcccccggcagccagcggtgataatgcagggaaaggcgccccaacctcagctacgcgggcgcccacagggcttctccccacccctacacgtgccccagcgccctggagaccgcgcctgggagctacgagcgagcaccttccctcgcagagatggatcagattagccccctggggcggtggcacctgcccgtcccctcccctcctctcttctcccacccccgccttccccctgctctgggccccctgcacctccctcttggggcccacgcgccgcccctctccctcgcttgagctctgagctcagaaggaacctgcccgcaaacctggctcccagccccgcccagggagcgcgcgtccctgagcccaagggccccagcgacagcagggactggctgcagccggcagtgcgggggtccagccggggcgagccggtcccgcttgctgcacctccgcctcgcacagtcgccggcagccagctgaaaacagcgcagccgcgtggtgccacctgctggtctctgggaaggaggaggatgggacggttgttgcggctctgggactgcccctggccccgagggttgagaagcatcttggcgccgggccctcagccgccagcttcgaggctgctgggagcagcagctgctaaggagaagcctgggtcagagttctgcccacccgcgcccatctccatcatttccccaaacctcgagtcccctgctttttaaggaatctgtgccccctaaactggctccttacccttctgagaagcattgacagtattccaggggtggccagcaccctgaaaaccacagcaaagcgggcagagttaaaatttaagactaaaaatgacagcatcaggcatgcacgcgggaaggaacagaacaaccagctccaggggttcccatcacccagggaggccaccaacgccccaaccaggagccatagcagcaaatttatgaaaaaaatattttattccaaaacactgtttacacaaatgtgtggtctttgtacaaagtacaaaaaaacccctcttctcatccccacctcccttcagagaagtttaaaccttgggctctcaatcttccatggtcagctgcccctgactgcgagtcctacagcctcagagggaggagcgtgtggggttgggagcaaggcctcaccagaacacagccagttacgcaacagcgcaaggcctgctccaggccccacctccagcggagtcaaaccagatcagcttttacccctcactccagattccacaggcacgcagcacatggctgatttgcagcttgtctttcactgcagttttttgtttttgttttttccaggaggcaagaggaccaaccctccaagtcccggggcccctgtccacccaccatatcctagacccaatcttttctacctctttgtcgacaaggttacaaacagagaggcaagcaaagaaggctggggcccaacggaggggagagaatatatatcccgggaaacgtgggcaacagcatcatagacttgaatgaagcccaaggccaagcagccaagcaaggactaattcagagcagctcagaaaccctcactcaaaccggcggcccccctgtgctaaggacatggccgggcccagacgcgctctcatagggttcacagagagtctggagtccacgttcactaaagtataaaatactactcgaaaatgaaccccagcctcccttctgagagatgaatcggttacatcaacacatgaggacagatgcatttacatagacccacacactctctctttctctctctctgtctctctgtctctctctcttaggagggcaaagcttctcactccggagtgaaacttcagcttacagacgttacctgtctcccctccccttctgaatcatctcattcaaatagctgctgagcagatgaggggcccaggaggaataggtctggctgcattgagtgcctgcagtgacagaggctcggtctctaccatgacagagacagactcggcgcactcttggatgccatgatctgaaaagaggccaccgctgctgcagccacatcccaggactgcacaggggaggcaggcgtagctcatgcacaaggacacacacacacacacacacacaagcacatgcatgcctgcaaaggtgtcagtgtacacagccttactaaactcacaacacgaccgcttcacattgcatattgtttccaaagagaagcgtgggattcaaacattcatgagagggagcctctggcagaggtgaaaagaccggcagggggcgagaggcgggagtcaagactgtccattggtcggcgtaagagttcctccacgtgcctggccacatccatggtctcatccaggtcgaattctccatcctgatcgagtacatggtcagggctggtaaagacagggggatgtca

SEQ ID NO: 3 - DNA, 58000 bp, Mus musculus
ttaaaaaaatttcaacctagctgggcagtggtggcacacgtctttaatcccagcacttgggcagcaagaggcaggtgtgtatctctaagagtttgaagccagactggtcttcaaactgagtttcaggtcagccaaagctacacagagaaaccctgtctcgagaaacaaacagacatggctggagagatggctccgtagttaagagcactgctcttccagaggtcctaagttcagttcccagttaccatattgtggctcacaaccatctgtagtgggcatctgacgccctcttctggtgtgtctgaagtatatagctacagtgtactcatataaataaacaaatctttaaaaacagaaaaatctgcagccttccacaggtgtgggaggaatgttttcaatctcagctcactcaggagatagaggctggaaaaaaatctctgagatcctaagatcctgtctcaagaaaacaggatactagtaagaaaacaaaaacctgaagtttcctgaactgtgtatattagctgtgttttaaaatataccattgggggattatctttgtggagaggtaacagccccttgtagattttagatttttatctttatctctctttgtgctaatcaccagcaatacaaacaccaataggtgtacttgtaagtccctaccatcacatatacatacaaatcactgcagtacgcagagttcattctctatgacagaaagccaagcatatacacgtaccatgaactgctgattccaactcagtaaaatctgtactcccaacatacaagacgtgaaataggtcagataatttcaagagcgtcaagaccccccccaaaagactaaatggatgttactcctaactcctgccactctagttaagcagtagtgggaaagtgtggaagaactggtttgtctcaattggacatttaagtttaatggtgaaagactagttaatgttaacaatgaatcctaaaatcatcagaatattttatgggctttctctctgtgtgtgttagcttcagttcttaaaattaagtgcctaattaaaagtgatttaattttgtctgcacgtttttctgcacaaggtgtgtgtctttgctgcgggcagaggcctgaggagggcttcagatcccccccccccccccagaccccagagtggagttacaaatggctaagagccatcttgtgggatgctggaacttgaacttgaatttttaccaggatcagcctggcagtccccttaacttaggcatccctctagctcctaaaataagtaccttttaatggaaacaagttggtcaaaactatctttcagaatttcaagacccagtataacagtttaaaaaaaaaagaactcagacacacgtggaaatggcaagtactgtgtattcgtgtcagctgtcatgcataggctctctgcatttctgtgagctgaccaatcagccttgctgttgagattcaggtttgaaatggtggaacagagaaccgggttatagccactattctcccccacgcaatctagtaattactctatttccacgtcatatttccgggtgtatgcccataatcacgcagaactgaagttcagagcagccaggagttgcccatgttcttttttgatgtctccacaaacccaaatgcttaagtggggtgacacctggggaccgcctaagtggctgattcccacgtggtaaggagctcacaaactcgcccccacgtggtgccaagggccgggaaaagggagagcgggcagaagcgagccgtatcagggcatttaaagtgtcttgacgtcacgcactgccaggaactcagctgagttttcagcaggacattccgctaatgtctcctccctccccccgggcttttttgtaagctaggcctctgcgcgtcccttggtcgcggagggaggagcacaaagctctcagaacagccaactcagggaggtgtgcccagagctctcgaccccgccttctctcctagaggcgtttttcattggttagtgggcggggcttaggaagtacagcgctcgcccggaggcctcagggtggcctagccagctggccattccttaattatgcatggaggcgtgtcttggccagtggcggctgggtggggattggctggaggggctgtaattcagcggtttccggagctgcagtgtagacagggagggggaacctggggttccgacgtcgcggcggagggaacgagccctaaccggatcgctgaggtacaaccccgctcggtgtcgcctgaccgcgtcggctaggagaggccaggcggccctcgggagcccagcagctcgcgcctggagtcagcgcaggccggccagtcgggcctcagccccggagacaggtgaagggggtgcagggtggggccacctccccgacggcacgggggacggcatgggggaccccacggttcgtcagctgtgggggtgcttagagctgtgaatggacacttacatggggcaggaggataggaggagacacacagggtcgtcccggcggcactgacgtccggatgacaggaaccagcctgggaaaggaagggacgctgtaagtttcgagggggagatgcggagagagagtggggagttctggggggtgtaggaccgtgggggggaggacattctaggctgagggtaacagaactgacagaagcggccctcctgtgactgctcccggaggctagggacgttcgggccaccagagccactgccactcaggtggagatcattggggtggaggcgttagaaggagcctccttcctgcccctgtgctgggcctggccgttccttgcctagccactttctttgccttgctcccgttccttctgtagtcagctgtacccacttaggaggtgggaactgttgtgtctctcctcctgcctctccgcccctccccctccccctccccccccccccccagcctctgggactggctagatttttttcttaagaatcagatttcctatagaaaattgacaaacttgtatcctttctaaattctctcccatctctttctgtgttaagctatgatttcccccaccttgttaagaacacttttttttttcccaattcaaaataaatccctggccaaaccagctctaaagagcaacaaacctctttcctctttgacattgttctctcataaacacctggtaaactcgacgagacgataaataattgagccattgcatttactggatcgtggtgttgcttaattgcacaggccagggtgagccaatcaagagtgggagttttctgtctcatagccaagctcttgtgtaaaagcagaagctagggaaacaaagacaggctggccttggctgagttctgtgtgtaaactttacctgttggggggtgtgtggctataaattggtaagttggcaaaatccagactgttgctcaagtcacttttttcatacctggtccacatccctcggttgtatcaattgatgtgtgtatgggtactgtcagtgcttattcagtttccttattcagagtgtgtgtagtttatacctgctgtttactacagtgcttatttgtgtatgcattgtgaatgttgggctgtcagtgtaggtgcagcatggacgtgaatatattaaagcaataaatcacttctatcttctttttaatgtggaattagactgttaggatttgagccagccattttttctctttttatattaaataatgtctatgttccttgaggaaacatgtttgtttcattattgcatgtgccggaccagaacactaagcgggatcttttaatttttttttagttttagactttatttatctttgttctatgtgtatgagtgttttgcctgcatgcacgtctgtgccagtgtgtgcccagtgccctaggtggccagaagaggacatcagagcttctggaactagtgacagatggttgtgatccaccacctgggtcctgggaatcaaacctagggcttttggggagaaccactgggaagagaatctggaataataataatgaaaatgttggagtgtttgttcttagtgttagcacactccccacaaagaaccattagcagattcatgaatcttttattttcatctgtagttcatcgggacaaataaccacttagagataatcctcagttatgaggctctcgataggggctgagagatagctaggtggctcactgaatgctaacctcattttgtagataaggaaattgaggccaataggcctagacacttgccttaaggcatcgtgagttacaatggtttaacgtctgccttttacatatttcttggtccatgcttaagtattcagtttcaatttagagtgagtatgttccctgttgagaagtatcagagaaaatctgaataatgaaacattggcagctgaaagccaaagtaactgttctgtgtctcaccctctctcctccctctcccccctctctcctttcccctcccccttccccctctctccctctcctgttagcataatttactgtcaaacttcagctatttttttaatggagatgtttaggcaaattttagctaaagggcggctgtgacctcaatgacatttcagccggagagccttgtggtcagtggtcgtttctgtctgtagaaagttcctttttcttttgtcttgacatccaaatgtgagaagggcgcggaggtagtgagcaccttccttgatgcccaagcccagaagccttttagctgatgttttctaagagatggtgatggtgtacagctcagagaatacttaacctctctgacattgtgaaaagtgctagggagagtgacatcttgtgtgtagatttgcaggctgttggagcaacttgataaatgctttattgtctaatacaacacgttgatgtcattaaggagagcaaggcattattacttacacctgtgccttctgtccctccctgctctcttctttccctcagtttccctcccttttactctccttttctccctttctggggacgaaacctaggttgctaacaagcactctaccacggaacacattttatgtcattcggattttaaagttctagccaaataaaaaaaccaaaaaactcatctaaagagtgcttgaaggatagccctaaatcttgaaggactcctggtgctgtggaccggcctcagtgagatggtggaggatggcattggcttgctgtctttgatggtgaaaagaatgtttggcttgctctggtgcagatagttgggattaccagattgtatttggtggcaaattcttggaaataatttgtttaaaggagtaacatttggaagaatgaatttctactatggttctcatttttttatgttatgtttgctataactttattcagctaacatacacacacacatacacacacacacacacacacacacacacgcatgcacacatgctagacggatgaatggtgctggcggcacatgcccttaattccagcacttggaaggcagcagcagtggatctctaagaattaagggccagctggtctacaaattgagttccaggccagctaagaccctggcttaagatgaacaggaacaaaacactaagcagaagctggccatggatgtttcatgtctgcagttttagcatgtggctagccaagaactgaggccaaaaaaaaaaaaaaaaaaaaaaaaaagtgagtttgaagctagcctgggttacctagtgaattccaagtctgctttgagtagctaataagaccctgtctcaaaaaaggctaggcaggtctgctggtatatgcttgcaattcaaggatttgggagacactggctggaggcccactaccaatttaaggccaggtattctgcgtagctagctggagactacctagcaaagccccggttcaagaaaaagtattttcacagagacaggaggattgctgcaaatttgatcaagggaagcctggggttcatggtttcaggccagctggggctatgtagagaaccccgtgttaaagaaccaaaccagaacaaaaccacagcagcagagagtagaagctgggcaggagccaaggagaatgagtattcaaaaccccacccaagttctcatggaactgtaggcctagtggggaccagagtgcacactgttgcagtattcacctaaggcagaggagtgagtggctcaagtctgaggctacggaggcagagagacctgggatccgatcctggattcactgcttcttggtcagaagctaagcctcagtcctgcctgtcccaccacggccaccccccagctcccctcctgtcccaccacggccaccccccagctcccctctggtttttttttttttttttgagacagagtttctctgtgtagccctggctgtcctggaacactctctgtagaccaggctggcctccaactcacagagatctgcctgactctgcctcccaagtgctgagaccaaaggtgtgcaccaccactgcctggctgagcctcagttttcttacctaactttaaaaaaaaaaaaaaaaaagacagacaaaagggtggggggaaggtcggtctgttggcatgttggcacatgcctacaacttgaggtatacagggagaccctctctcatgcaagtgaaatgtttagagcatgcagctccacagcaagagccctgtatatcttaagttcttaggaaaaggtccaaggatagagaggctcattctatacaggggtgagaggttacaggagggctagtttccgggaacaccagagcacttacaggagggttaggaattcttgcagagcttgtacagttctttcaaggtggtgggggcgtggatgtgctgagcttaaaacagcatagtgggtttaggggctaaaagtggaagctcttaattgaggagaaggaaacaggaaggccacagagccacatcttttatgccttctcttctgatcatgtcactagaactgtgttttaaaaagattgaattcttttcatgatagtaatatatgctgtgttaaaaagctttacctgttttcctgttaatagttcagtgtgtgttttcccagacactctttaacttaccagttcattttggatctattttattgaaaatcattttaacagctcaacaaaataatatggaaggcaaatctacccccataagaaagtgatgtttagaccttggctttccatcttgccagctctatctgtggtaataaatgactttactcaccactgaacaattgacctgacctttgaccttttaaatgcgtcagtcaagaaactcacattctgagctctcctaaggtaactattgcttgggtgatgtgcttgagggttttgtggtacatggacagacgcaatggcattctaaagcagcgctatgaggccagacaccttgggtttgaattttcagatacaacacctctttgtccttaaggctggttgctttaacatctctgagtttcaatttctttgtccacaaactgcctgctgggtccactcacagggtagctgtgaagaccgagtgagatcatttgttacatcataagaaattttgcgtggtgcctagcacgtagctaacattcaaatgatatcaattaacactgaaatcttcaatctttctctctggttaccaagttgggcaagttatgattcatggcaccattagtgacctgaaggaaagaaagagtaattaggagattttgacctacaggggaagctaagtgactagggactggggatttacatggtgacagaggagatatatctttgacatagagatatagacatggcaaactgtacattcctgttacatagaggctctcatgataagcctctttgcagcttcaaagacctatgatccactccatgtattttaatagtcaacacattgaaagttatcactactcagtaatagtcccttggagtttttcatgctcttaagaagtatagacagctacaggctaggaacatggctgagttggtagagtgcttctctagtgtgtatgaagccatggcttccatccctaggactagataaacccagatttagtggcacactcctctaaaaccccttgttgggtggagataagaagatcagaagtttgaggtcaccatggactacactgggagtatgaggccagtctgggctatgtgagacactgtcttgagacatgggtggtggtggtgggtgttgctggtggcatggctcagtgggtaaaggtgcttgccttcaggcctgaccacttgagtttgatttctttctttctttctttttttttttttgagacagggtttctctgtatagccctggctgtcctggaagtcactttgtagaccaggctggcctcgaactcagaaatccacctgcctctgcctcccgagtgctgggattaaaggcatacgccaccacaccgggctacgagtttggtttctggaacctgtgtgatggaaggtgagaattgttttccacaagttgtcctctgatgtccacacctgcagcatggtttatgtgtgcatacatatgcacaactagagtaatagactaatgtaaaatgattttatttatttattttaaagaatatatatatatgtgtatgtatgtatatatatgtgtgtgtgtatatatgtgtgtgtgtgtatgtgagtgtgtgtgtgtgtgtgtacactctacactctagctgtcttcagacacaccagaagaaggcattggatcccattacagatggttgttgctgagaattgaactcaggacctctggaagggaagttggtgctcttaatcactgagccatctctccagcccctaaaacaattttttaaaagggaagcagagagaatatgattggtggtgtgtgttcataaaccccagtgatgctgaagctgaggcaggaagactaggtgtttgagaccagcctggaacttgctcagattctgtgtcagatttttgaaaaagggccagagatatataactcagtgatagaacatattcctaatgtgaacagagctttgggttcagtctccagaaccacacataattttatacactatatatatatcacatacatacacacacacatatatatcacatacataaacacacacgcatatatatcacatacataaacacacacatatatatcacatacatatacacacacacacacacatatgtaatgtgtgtgtatatgtatatatgtatgaatgagagacagagtctcagtatgtagctctggtggtggcaggcctggaactcactctataaaccaagttggcatcaaactcagagaacagagatctgcctgcttctgcctccctggtatttgtattaaaggtgtgtgctaccatagcaaaaagataagggacagatactcttggacagttgaagggtagaggagtggttagggttgaatctttcttaggaaggaggagacgggagaggggaagaagagatccagaaggcttggacgttggatgacatccatgaatgacccacatgatgctggaagttgctttgctgtgtcctgtgcagctgatagcgtctctcttcacatctgtgtgtgtgtgtgtgtgtgtgtgtgtgtgtgtgtgtatgtgtatacaagcatgtgtgagggcgtgaatggacgtgcagatgttcacagttacccttcacttgatgtgtatatacagctttatcttcctgttctgtaacttttctttgtacctaacaagtgaatagcctcacagataacaacctagctcccatgagtcaaatttactattcacctctttaagtttgggttggagaagacaggaatggacctgcaaccagtccaacccagtgggcccatgtggaacagaaggaagccagcggagctagaaagagaaagtgaaacttgtaactaatggcttccgtgttgtggaggaggggcgcagtttattacggggatgtttgggtagtttttgtagatgccatttctgaaaactgcttgggattaggaaagaaaaaccctgcctgtctgtgtagccatctgctttcccgacggctgattgattttattagtttgcggtgtcccgacctcttgttctcggtatgagagtctgtgctttgagtctggactctgcacctgcttaggtgaaagcttactagcaagtttccccacattgtatctaatgctaaatttgttttgcttttagagagctcgctttttttttttcctggcagaatctaaatgcattagactgttcctttgtctccccctcccacccgcacaaaaatcctaaaaacctcaaaacccaaatgcaagctgtgtaattacctttcccgtaagccaaacaatgtgagttatcattaaaatagttagcctttgaagtttttcctacttgtggtttggacacaataaatatttaatgtaaagctgacttcccttggcaaatcagtgttgttgtggtcttttttctgtcaaaatgtttaggaaaaacaaacttcttaacattaatcaaagtaaactcatgcataagagggggtgaggtaattaaagagctctgaagccggtgtgtatgtaaatatatgtgtgtgcatataaatgtgtgtgtgtgttttaacaggtttcactgtctagcccaaagatctctccacattcctctgcctcagtctctttaatactcattcctaattacatgtgagaaaaaaaatccagtatgacttcgttcatcagggcaggctcttcgtggaacggggagtgttctgggcgtgggacgctttcaagccccagtgactgtattgaagattctcagggtcacggagtcattgggaaagtcagtgtctacagtgggggcactgcacatgagagcaggtgggaggaactgggaatgctgtaccctgctcagttttgctgagaaccaaagctgctctggaagctaaatgtggtgggctacactgtagtccttgtacttgggcagaaacaggagcgccttggtgaatctgagggcacttgggctgcataaccagtaccagaccagccagggcctcagtggggagcacctcaaaatgccaactgcaagcaaataaataataagtagataaataaatatgtgtaatttcctctatatttttaaaaagctgatttcaaagtttattaattaaaaagtgattttttttccctgcagaaatatctgggtgccctggatgacaagtgttctgtggggtctggggtcagcatggggggacagtgcatgcctaagccgtgcagagccctgaaaggatgacagaggagctggggtgtgggatgtgagcagacactgacttaaacatgagaagagaagagaaggtggctttgtccaagggggaaaagtggtgatatttgttgcaatttgtaacatgtaacatttgaacttagaaaacgattaaaaaaaaactgtaaaaaaattgagcttagcagtaaaaattaaaaaaatatatacttcccctattcagtagtttcctgttattaatgaatgtaagtaactcttcagtgttatcggatgtgatttttttttttttttttgtatgatggagactaaaacgtgtcagcgtttaagtttgtgcatcttaaaagcaatgttttctaaatgactaatgtttattacaaaggcacgttggcagacattccatgaaaggtaccaggtagagggcgtcttaatgtagccgagggtgaccccagagtgcacacctacctgtcctgtggagctatcacctggcagtgttttaaatggcattaaagattccagattactttgaaagagtgtgtaatctgctatttgctattcagcatatctggatgaagccagctctcgatggagtaaccaaagcaatatactgcaacaagcatatgtaagctgttctgagactccaacagctctttccctccctccctcccttcccttccttccttccttccttggctctcatgcatgttagactcagttacttagccacggttagccctgaacaccgaatccttctgccttcacctctcaagtgctgggagaatacacctgaggcattgcacccacccagctttaacacttttctattggaccagaaattagattactaaaattttctataaaaaaaaaaaaatgcagttctgggagagccagggctacacagagaaaccctgtctcgaaaaaccaaaaaaaagaaaaaagaaaaaaaaggtattattagctgggcagtggtggcccacacctttaatccagcacctgagagacagaggcaggcagatctttgtgagtttgaggccagcctggtctacagagtgagttccagaacagccagggccacacagagaaaccctgtcttgaaaaatccaatcaaatcaaccaaccagacaaaaggcacatttaattttatgattctctgtatgtgcaggcatgtgtgtggagatcagagagcaattttctgctgtccgatctctgtttccacttttatatgggttctggggatggaactcagggtgccaggcttgtatggttggcacctttccctcaactcctctgagccctctctgcagccctacatttgtgaaactttcagcggtgccgcttttcccactgatttctcccccttcggaacatgtggttacctttcataggctattcctgcgacttatgttaatgtgctgtgcacagttaattgcttaaatgaactttgtttgagacagtgtcttctcgtgcaatctattaggctggcctgggatttagggaccttccattggggcctcttggccagcttatacttataacttctattgataggtggtatctaataggtattttctggtgttttgagtcaaggtcttgtatttccaagtacccttgaactcacagatcctaagctggcttcagttttgtggtaatccttctgcctcagcctccattgtgctgggattacaagtacatgctaccactacaaatttttaggcatctctaataaatatggtctctgtaaatgaagctttgttagggtccttaaattttgatagcaagaccagtcctaaaaacagtgcattttgagaactgttaaaaactattaaaacagccgggtgtggtagcacacacctttaatcccagcacttgggaggcagtggcaggcagatttctgaggccagcctggtctacaaagtgagttccaggacagccagggccatacagagaaaccctgtcttgaaaaacaaaaaaacaaacaaacaaaaaaactattaaaactattaaaaggttttggtataaatattcttgagctgttttgaggagctagggttggggagggagatgacatctatggctctgattaagtggtctcgggacattgtaaccactgtgccaggtatcatggtacagatgggtccgtaatttgagaaacacttttacaagggccataaattcttcagatgaatgaagtcctgtctagaagtttggaagttattgtcttaaagaaaaactgctttggagattcctttttatcttgattttccctggtatttatgtctctaagaatgaatcttggattgcgtctgattgacaaaagagccatacctcaccagattctggtagcttctgagtgcttggttgatttcttttcttgttttgtttttcttttcttttctttttttttttttttttttttttggtttttggagacagggtttctctgtatagccttggctgtcctggaactcactttgtagaccaggctggcctcgaactcagaaatctgcctgcctctgcctctgctgggatcaaaggcgtgcataaccacacccggcttgttttgtttttctaagaaagggtctggataaccctagctgtcctggaactcaactttatagaccaggctatcctcaaactcagagatctatctgcctctgcctcctgagtgctggaattaaggctttcaacaccacacgcagctataatttttaaagataattctgatgcgaattacagtttaatttggaaagaaatgttgacttaaatcagatataaaaggaagtttttttcttgctgtagtgactgtccttggatgttatctgccatgcactcacttccctttatcagctgtagtcacttctctctcctgtccctctctataaaatgggaaagacttttactgggagcctgctgatatcatcagtaccctcagggttccctctggttgagagagtgactggagagattccttgtgaattcttgcttccggcacaggttacagctctccctgaaacctgaatagggttgttgttgttgtttccctcctcctcctcttttttttttagcagagtttctctgtgtagccatgactgttctggaacttactctgtagaacagactagctttgaactcagatccacctgtctctgcctctgctggaattaatggcttgttccacctctgcccagcttgttcctttcttaaaaaaaaaaaattaaaattaactttatttagtgtatatgtatccccacatatacactaggtcagaggacaagcttcaggagtcagatcttgctttctatcatgtggaccctggggattgaattttggtcttcaggtttggcagcagcccctgctgagccattttctgaccctaatattacattgttgttgccttctgtgtgggagccaatcatgagagcagtcgttcttatttattcttctcagtatgttattaattttgtgaagacttcatagaaaagcttgtgtagttaatctttctggggtcagactgcttgttttgttttgtttttgcttcgtttgtttgagacacggtctttatcccaggctggcctcattgtatagctgaacatgaccttgatttttgtttttgttttttgtttttttgtttttttgtttttcaagacaaacccttgctgggttgcaactggcttgtagaccaggctggccttgaactcacatagctgcccatctctgcctcctgaatgctgggattatagcatatgctaccatagctggtttatgtggtgccaggtatgctaggtaaacactctaccaactgagctacatctccagctctaggcttgtcttttttaaagctttccataaagttaaattcatttcaaacacacacacacacacacacacacacacacacacacacacacacacacgtttgagtcattgttataaagctctgtgtgggcctgttgcttgatatatagtcttcattggccttagacctatggcaatcctcctgtctctgcttccagagtgctgggatacaggtaggttgacaaagtagaaaatacctcttactttccctgtccagtttctccattgctagcatcttgcattagtgtgatacatattatgcagttgataatagcagctatatgttgttattaattaaagaatacacagtttctatcacactttactgttacatattctttgctgtttgatagtgttggagacatgttgtctgttgtagctcaggatgcaagtaaacttggaatctgcccatctcaggttctggagtcctggcattccaggtgtgcccctctgtgcttgggccattttgtggatttccacagacatgctgtgtggccaccagcacagtaccacttgaagtacactctgcctccatagcccggtgctctacccactcacccctctgcagcccctgccagtcgctcatcccctttttctatctccatagtcctgtttttcagaatattcatctgacatcatgtaagcagtagccttctaggcagcagtggcccagtgcctctctggttcgccttctttcacggagcagtatgcgttcagcttcctccttgcctttggtagctttgcgaggaacactgccttgtatgacccttcccttagtgatgttcccttcatctgaagggcatcttggctttgtcgtttgggctgataggaataaagctacccattattgtttgggtttgcactcttctaatgaccaggctggcctcgaactcagaaatctgccgcctctgcctcctaagtactggctttcatatgccgtctgtgtactctctttggtgtgatatcggatcagactttctcccaattttgttccatatttccgtacaatggaaattgaatttagggttccacagctgggtgtagtggcatgttcctttaatctcagtgctcaggagacagaggcgggcaaaactctgttgagtttgaggccagactgatctacagagggagttacaggacagtcagggctacacagagaaaccctgcctcaaaacaaaaaagcaagcaagagtttagggtcctacttactggcaagtgttctttaccactgagctacaccccgatccttattttaaaaaatttattttgagaccagggtctcataactttgatcaggccagtcttgaagttgtgttgtagcccatgcaggacctgaccttgggaagcacctgtcttggttttcccagtagctgggcttacaggcctgctctgccaggcccagctctcacccagatttacacggagatttttttttttaaattgttgagagttttaaaagtttctcagtctgtattgtatatacaagtgtacatgtacatttgggggaggagaccagggccataacacacaaggcaagctccaacactgatctgtagtcatagttttctttcgatgtattgggtttttttgtttttttgtttttttgttttttttgttttgtttttgtttttttcatgaaactcaatgtcttaacacttgttagactgggctatgcctctagcccgcctcctttttaggtggcatatagttttaagtttttcttgttggagaattcagtctcatgcagacactaatgctgtgagcttgaagtcagagacaaggaagtgaagtacttgtatctcaccagcccaaatggataattatgatcttaacctttagctccactgcctttagataaggctgggcatggggctgcagccccaactacataccaaggtgctgacacttctgttctgactgctgtctctgctcttagacctgtcccctggattatttctgactcctcctttggaactgagccttgctgacttggatcttgcccagcttctactctctgttgctgctgttttgtcctggtttggttccttaacacagggttctctatgtagccctggctggcctggaactcaatatgtagaccaggctggcctcaaatttgcagcaatcctcctgcctctgtggaagtggtttttttcttgaaacaggatccaacaagctacgtacaaaaaatggtcttaagttactgctaggtatgtaaccttgggcaagcattgacattaaggcacacccccaacctgaaaaataattgtttgagaagaatcagcatttctagaattattcttcttggtttttaatttaattttattttttaaaacttaaaatgtgtgcagatgcatggtgtatgtgttgtggggggatgcaggtgcttggtgtttgtatagaggtcagagatcaattttgtggagttattttttcttctatctttatgtgagtcccaggttaaattcaggtcaccaggcttatacaacatgcccttacctactgggccatcttattggccttcttggggcccattttaatctctgtcttttggggggtataaattaaaggaaaaaagtaaaacatagccttccagggggctctgggctttatttaaattaaaattttcaaaatgattttattttatctgtatgggtattttgcctgcatgaatacctgcagttcacggaggccagaaaaggacatcagagtccctggaactggagttacagaggttgggagcacctgtgtgggtgcttggaatcaaacccaggttctctggaagagcagccagtactcttcttaaccagtgagccatctctccagccctttttcttgagtcttacagacctttccttatgcccttcctttcctggtcatccttcttctgaactcaaaggttgaagagcctttgccctctctgggtggggttctcttctcttcactttctgtgttctctatgtaggttatttcagccactgctttgatgtatgtatgtatgttacatggctggggagtaaacccagggctttgtgcatggaaggcaagcgagcaccctaccgactgagctaggtccccagctcacttagccattactttggccataattctgataatgaccaccaggtgttcatctccacccctgtaggcttctagcacccacctcgtgctgctttccgacatttctccatgggtaccttgtgtgtacttgcctcttggtcctactgttgaaaacttaaccccatagccacctctctgaaagtctgtgcttctctcttcgttcaacaatgaaataaatgatagttcttggtctgctgtcttagttactgctctattgctgtgataaaacaccatgaccaagggaacttgaaaacatttagtttggagtttatggtttcagagagttagagaccataatggcagggaacctggcagcagacaggcagacatagaactgaagtaactgatagctcacatcttgagatgtaatcacaaggcagagagagagagacagacagacagacacagacacatggggcagggagactgagacacagatacagagagaatgggagacacactgggaatcctgttagtcttttgcaacctccaggcctgtaccctatgatatacttcttccaatgaggccatacttcctaatccttcccagacagttccaccaactggggaccaagtatttaaacacacgagtgtgtgagggccactcctattcaatcatcatactgtgcaagccagagccccccagccaaccttgactccttccctccctcatcctcctgcttctgttcagatcggcagcgagtcttgatctcacatctcgagtttcctcaactccccttgactgtcatgtcccttctgtggtggtgatgctaaaattgctcctgtacaagactcgaaatgctggataaatggagctctccagtaaaaagaaaacttaagatgcaaaagcagatagtctcatcaaaagaaagaacagatgcaggcctggagtgtttcatcccacaccacttctaagtattgatccccagtcacagccctaaaatgcctcaggcttttgagtgctgcattataggcatagaccatcatgctaggcttcaggagttctcactcccatcccttcacaccttgacctggcttcactgtgcagcccatagcccaggctggccttgaactcaccattctcctactctagcctcccaagtcctgggcttataggcttgtgttaccacatccagcttataggatcatcacctattctcctgctatccgctgaggcttctgacctgccatctactgtaccttccacctccagctttgggctgtttgaggttgtaggccatactgcacatccaacagcactttggtgctattttcttacctgtgctagctcaggtaccatgctgcactctctgggttctagagttctatgagctcccccccccaatcccttccatcttgcttttcattctttgtccatgtgcttaggttctgatcactcagaagattcgtcacattccttgttttcacacgctgttccctttgcttagactggctgccccttcctctccagaatggccatgtctcctgtagccctgctatctttgtgaaactttccagctctcattcttagggctgccattccatcaaaacagtgctcggtgccttagacagtaggaaccaagctgcgtagagcttgcggggactctttgccttaccagatgctaccccaagctgcctctcaggctttgtctttgtcttagaggaggctctgactctacctgtgtttctctgggcttagcagagcacctggcaaagagttgctgaaatattcagcaagccagtggagccctgtacggctggcctgaatccatagatcggtcagaaaaccacagagaaaagaaaagcatgcattttgcatgttgctctaccaaggccacaattatactctttctttttctgagatagcctctgagcagtctcaactattctcagacccacaaagtcttagtcatctaagtggtggtgttgagaggcagacaccagactctggtgctcatgggcgaggatggggctagaggtgagatctagggactgccggagtgtagagtgtgctttgaaggagtgagactgcatgaatcatttagaaagtgagttgtagagaaagcaggaggtttatattaagagagttttacagcaaagcctgtccctgtaaaattgtgaaatattttctcatgaatgttagactctgtaaagattgcattcagtcattcatttgggaaaaatatctttggaatcaacaaacacagtgaaccaccttgaacttcatgcttaatagacaaacattgtgttaactctttctggggcagggattctggagacatggcagggggtggggggcgcttgtcttcactgtgtgatatctgggtatcagctgggaagccttgaacatctgggcttttctttagttcccagcccaggcctggcctagcatgattgcagctgtgatggtagatcaactgcatgtggcctctttgtctgtcttgtgtttcttgtagaatggtggttgggttctggagcgcctttgtcctttcaggagaatcccaacagaggtgttggagatttcatatcaagcttggtctcatggcacaggtctgaaatcctagttacttgggaggctgaggcaggaggatctcaaatttaaggcttgcttatactactgagtgatttcaagaccagactgagcaatttagtaagactttgtttaaaaacaacagaccccccccccaaaccctcgaaagtcaggtttaattcctcagcaccacaaatgagacagtgcatttcacactttcagcactgtgatgctgggctagggatggctttagccaggtccaggggaaggggagcaaaggatgaggaaggggacaggttctccatccaccgctggacgcttgggtgtgaggctctcctacaaatccactatgagatgacgtcaagggaaaggagcaggtgtgtgccaccatacaccctggagagaagaatttcctccctcctcttccctcctgagcccctccctccctcctctcctccctccttccctttctttttacctcctttttgaggcagagtcttaccttgtaatccaggctgttcctgaactcatggccattttcctgcctcagccttctgagtgctaatattacagatataaacatataggttcttagcccactttagcctctgctgaataacaaagggcttccttggggtcacttaaaggaaaagtgacctgaataaatttggggaatttctttcttttctccagtaatcattgagctacatcgtaggcttgtgactttgaaattccaaacttcatttcctttatcagatcctgtatctctacctccctagcactggctcccaagcccacgctgcaggtgctgggacccaaacataggtcctatgcttatgtggcaggcccatacagggctatctcctcagccctgaaatgtttgtttttgatttgagtaacatttctcttgttaaaagatccctaaaaagtcgttgagttttccaaacagcaaaacagaagagctggactcctcaatgaatacttttttgctgggagtgtgtcttcactttggaaaatgtggtccccttagccaggagtggtggcacacgcctttaatcccagcacttgggaggcagaggcagaaggatttttgagttcgagactagcctggtctacaaagtgagttccaggacaaaacaaaacaaaaaaatgtagtccccttaatgccagataattccctccagcagttcatcagttctactacacacacacacacacacacacacacacacacacacacacatgctttctgttcatctgttaggaactggacactgtgctggatgctggagaggggggcacattagtgagccgaagccaaggttcttcctgtcatcatggaccttagaatgaaggagttgaagcaaggcataggtcccctgatactgaaggcaagcacacatgtgaaggcccgtgaacggaggagtagagtagccaagtgagtgtaggagtgtagctagcaggcaagtggcagccagacagacacagggctatcttgtcatgcatgtttgctctgtcctgctagctttgtgtgctttaagtccggtctgacactgaccctgtgaagtgagtacagttgtcttctatttttctgcataaggaaggctagacacctggcacgcatctcggaggggagtcagggtccacaggctgttgctttcatagttgatgatttttagtctcagagcaaaaagtggtgagcctttatggacgtggatggcagctcttcagaaagcctggagggatgcaggcagatgtgcagatacaggtaaaagctcctagctgtgggtttgtagaagcctgggagtgttttagaaacagctagagtacagactctggacatctgacccttttggttaaatgtcaacctgctttatctctgcgcatgtttattattgggatgcagcggtctcagtgtcccaagtgagcggagctgaaatggcttcagaggccgtgcagccccttgccctcctggagtctgcattatggctgtgatacctcaaggaagagcatctccatgtaagtgtcagatgcaacaggaacgaggcagctgccccgtacataactctcttcatgccattgcccagtgaagttatatctgagaggtctgttttttggagacggcttctcagcactgactgtcctggatctcactctgtagaccaggctggccttgaactcacagagatcctccatgcctctgcctcccaagtactgggattaaaagcatttgacaccaccacccagtttagaattccatttaaattgtcatctacacaatgactgtgacctcccagatgtggccaggcacagcaagactaacagaccctttggctcaggcgccatacatctgttggaactctggaaaagttctttgacttagcatcgttcttgactcatgacaaaattcccagatcagaatccccaggagctctgacagcaggctgcatcaggatgctgctccatgccattactgcctgtgagatcctgaataaatcatgtcaaattctgggccttcatttctcctcggtaagatgaagataaaatattgtcttgaccaatgagatggctcaacaggtaaaggtgcttgcagctgagcccgacagcttacgtttgatccctaccacccacacagtgggaggagagaaatgactccttgaagattgtcttctggatgcaccacatcatcattatcatcaatggttagcacaaagatgagatgaaagttccacacggtattcagctatagatactggttttcttcttttctttcttccttcttttttttttttttttttttttttttttgaagacagggtctcatgtagcccaggctatcttcaaattcactgtataataaggatgaccttgaacttctgatgcttttgcctccacctcccgagtgcttgcgtgtgcacatctccatgccatgcctggttttatgtggtgttggcagtggaacccagggcctcgtacgtgctagggaatctcttcactaactcagctacacctctagcttttggattgttcttcaaccaaggctcttgttgacattcatctttttattttgaatagtacttagtgggtttttcattgtatgctgctggtggtggttttaagacagggtctagcatagtccaggttggcttcaaactcaccatttagtggaaggatgtccttaaactgatcttcccatatctaagctctaaggataggaattgaaagcatgcattttcatctttagtgttattaggcctagagctatcctgtgcaaaatatgtgtggagagatttgatcatcttcagacatctgtcctgaggtagggtcaccagatgctaattccccccaccccacccccaggatatgacagcagggtccattataatgcacgtgcttctccatatcagggaaagctctgtggttgtctctgataacacctagggaattggatgaactgtttgctctttggcttcctgaggcactgagaaatggaattcctgttaaatgagagggtcaaagactcagaaggagcaactactgttcacctgtgacgtcacttaagtttagtaccatccttccgaggcggggtagtccctgttgtgctgaagaggaggcctattcagcagtcaagccttgtagagagagtggaagggtcacagcctggggaggtgaccttacgcacaaactgagtccttttccttttttctagagctagaggcagctctgaccgtcgacttagtggttgacaaagcacgtctggctgtgtcaatctaaaggtttgctgtcttctggctccttttatctacaatatttgaaatcaaatatggtgcatatcccatatcagttatggatttttgtagtaaatatttaatctcaattgggggtttctaccccaccttagatcatttagttcccagataaaagacccaaaacttttatatttataataagccttaaacaacactaaagctgagcagatatcatctctctgtgtctattttgtctactttcaggcaaataaccctgagctatgacttgccgtgttccacttgagccgctcttactccactggccagccctcatggccagatctcacaatctcttaccccatggtgtcttcctctctccaccttctctctcttccctttcatggtcctttctctgaccccaagcccagaaaccaaaattctacccacctctcttctgcccagctataggctgtaggtgtcttagtcaaccaatagttttaaactaaggagcaaagttgcataacatgacttggtgtgtttgaggatttcctcatccctggggcaaccgaccctggggccagtattccgcatcacagtacataggaataggtcagtgcattatttgttttgtgttctctctgtctccttcccctacccccctttttcctgactttcatgctggaagtgaagaggaagtggtgaatcacacctttaatcctagtacccaggaggccaggcaggcagatctcttgatgttgaggccagtctgctctacatatccaatttcaggtcagcccgagctacatatatggccccaaagaaggctttttgacacactgtgaaattgaacaggaattgtcctcttttaaagatagagtcccacttagctcaggtgggcactgaacttattatgtagctgaggcagactttaaactcctgagcctgctgtttcttccttccgaatgctgggattaagggtgagtcccattacactcgcttcagaaatgtctctgtatcactttctgttgtggatttttatttgcatttgcattttgtccctctcttcatcctccattttaggtttactggttcatttatgttcatacatgtcttagagagtttaggaagttgtgtgattaaatcccttctatctgtggtctcctgtggttcccctagtttctttagactgaactatacaaatgaggactgttactttaatgataatttttctattaagaagttccttattagactgaaattattttccttatgacttactgttggtaggttattccccacagggctaagaaattgctgtttggaaaagtctagaaggatttggtgacatgctgtttcattttccttttctcttgagctatagaaactaggatcatcagggactagagagatagcttgttagttgagagcactgactgctcttacaaagaacacaagttcagtttctagcaccctcatggccattcatcatccaactgtaactctactttcaggaaattcagcgctcgtgtctggcctctgctggtacacacacaaacacacacactgcacatatataatatgtaagcaaaacttttatatacataaaataataaatctcttaaaacagaagaaaatagggtcacagcatcttagttactgttctgtggctgtgaagagacccatgaccaaaacagctcttactaaagaaagcatttaatttggggcttgcgtacagttttagacggttaagcactgctcatcatgacaggaagcagtctggcaagggacagtagctgagaactttatatcctcacagtagcaggcagagaaagataaggcctgatatgggcttacagtgacaaacctccagcaggccacacctcctaatccttcccaaacgcttccactaactgatgggcaagcattcaaacatatgagcagcattctcattcaaaggttcacacacactttatctttcctctgaacatttgcaatgatgttctgcccacctcagcctcatgaaagccagcagagcagcaagcttgtgtcatactctaacccatccactggagcaatgacttgacttctactctggtgcccaggatggtacttggcattcaaactgttggtagatcactttttgtgttctggcttctgagagctggttattaaagcacaggcttcaagtgatttttgaagacaaaagttagatcttaacagaagtcgggcatgatgtgtgcccttccagtcttggtactcagactgaggcagggagatcagccagcctacactacccagccatagcacgtagagtggatcagattaagttgtttatgttggtgtttgtgatgctgaggatgcaactgagcatgctgggtaagcactgtaccactaagcaatgtccccagcctcttaaatcagtttctaacttgaaaaacagacttgaggtggtaaagtgtcttctagatgttttccaggaaaacaaatgcagcatacggactggcagaggtttcctggacagcttggctgacgatctctaaacgcccagctgtcagtgtgcagaatgcttagtctagttgctcttgtgttgattagtatggcttgcagctaagcagcatctgaggacatggctgttggacactcagggctaaaccatggcacccacacgcccatgttctcctgaaaataacatctgcgctttgcttttagcttaggataattttcttcatgtagaatagtttggcagtattacctatcttggttagatcaaaacaaaacacaaaattagtcgttcttgatggtccagttaattggaaaaaggcacaagctggtctctggttaagaaaaagccattctaccagcgaaatacaccaaacatcaacactgaaacaagcctcttgagttacagacagaaataagtcggctatgggtaacttagcttttttcttatgttagattgaaaatgttcccccgactggagtggtcatctgtgatggagtaggtagagtgggtgaggttttatggtttttatcttgggactggctctgcatttgtgtccaagataaatgatgaaatcatctggttttgtaacttatagcattggaatttactatttcaagcagatgatttaattaggatcatggcattttttttacagtgtggcccagaacgacagtgtctttgattttcataaatagaaagcgggtcacatatgtcatactacattttcttttcttaaggttttgtttgttttgtttttgttttttagatgggggtctctgtgtagttctggctttcctggaactcactatgtagactaggctggcctcaaactcacagatatctgactacctctgtctcccaagtactaggattaaagatatgcaccatcacacctggcatgttaaattttctagtaactgtattaaaaaaaaaaaagaagtgggaagaataattttgataatgtataaaacctaacatttctaaaataatatttcaacattgagatttgtacatttatttctttcactgttttcaaatgctgcatatatgggtgtgagcgtccacacttccttggcccagtggccacaggtgggtggtgtctcccatgctcaacaacgcaatcttttggttcaatggagtcctgtgcagtgatgtttacataaactgtcatatagattttcttttgtgtttctttgtgcacatgttcatgcatgtgtaggtacatgtatgtgcaggtcaaagggcaaccgtgggtgtcattccttcgacttttgtttgacacagcatctcattagcctgaaactttgccaagtaggctagaccaactggccattgaacttccaggggtccacatgtctccacctcctatcttgccctcattggcattatgggcacaccaccacacccagctttttattaatatgtgagttctaggaatccaatctcaggtccccagcaagcatggtaccaactgaaccttcttcccagcttcaaattggtatggactgctatgtaagtcaggtcctgggaaccacaggacaacaggaagcttttcatctaggagaggctgattctgacttggcctccatgtaagagggccctgatagcctttggtgccttactggggcactgcacggagaggcacagcgcttcaggctggagcatgtgttcctgcaggcggcttttattccacctagggtttgctgtacacataccactccctaatcttgggctcttactcatggttatttttagacctccagtgttctggagagacattgtcatgagtggttagctgggtcgggttctcgtagccgagcgttggagtggggcagtccccatctcaggattaagttgtttacgtggtattcagctctccttcctttcttaccccagatttagaaaaaatatattaaaatctatttatataaatgtatatttatataaataattccttttgttgagtgggcagagtccaggcacatggctcttgtccttgtgagcctgccgctctgctctctgtcctccctaagcaccggtctgagccagtgcaggtttcctgtctatagccgcacggatggcctggatgcagcaggtgtgtgtgggagggaaggaaccgaaccgacgtgtgctggacagctgctgggcgctgtattcttagatgaggctttaggaatattccttcagcggccccaagaagtgatcatctgtattctagagaccaggaaacagaaatccagaagaaggaaaccagccagcttcacgtgacatttgcttaaccccgcttgacctctggtagagaataggcttgttgttgtcatttggtcaggtttttagatttattttatttatatgagtacactgtagttgtctttacatacactaaaagatggcatcagatcccattacagatggttgtgagccaccatgtggttgctaggatttgaactcaggacctctggaagagcagccagtgctcttaacctctgagtcatctctccagccctggtcagttgttttgttgttgaagatgatgatgttgtttctttgtttgttttttaaattttttattttgttttattctaatgagcatttttcccaaatgtacccatgtgtactatgtgacttgtccagtgccttcagcgatcagaagactctgtcagatagatcctctggagctggggataagtatactgtgagccaccatatgggtgctgggaattgaacttggtcctctgcaagagcaacaagtgcattaaactactgaaccagctctccagcacatgtgctctctctccccctgtgtatgtgtgggaatggaggtggtggcgagggtttagggctcaggctggccttgacctgtctgtcatgatatcataggagttctgggattacaggcatgagccgctgtgcctggcttcaaagtagattctagaacttaaaatcacacctaattgtaacagaagaaattgcgtggcagccttgaatggcagctcatgcctgaaattcaagcacttaggaggcagaggtaggaaataacaaggctagcctgagaccctgttttagaaaatcaaggacctggagactagctcagtggtggagaacttgtatagtgtttgatccccagcatcaggagtgggcagagctgtggtggtaggatttgtgaatgcaaacacgtattattcaaaggactacaaaaaacatacaagctccttttcagagtcaccagggtatcccctatgagtacttgtggtgaccacatatatattttggcttacagtcgagacccctgactgcagcaggatggctcagtggaaccagctgcagcagctggacacacgctacctggagcagctgcaccagctgtacagcgacagcttccccatggagctgcggcagttcctggcaccttggattgagagtcaagactggtgagtccttcttgaaaactccctgacttggggggtttagcattgagtcaggacacaacctgttctaggttcacaccttactaaccctttgatcagacatgtgagggcaggtgcgggggaaggattgggagaacagaggtaacttagtctcttaacgcatctgttcacagtgcatatgacagcggcctctttgcactttgaaacagcttgctggtagatgttttggagtcaggtttgagtctcacttacttggtgagatctctgcacattttgagtctagaacagtgagatacagatgtttttcctttttaaatctaagaattctatgtcaggtagaaattggggtctaccacacacgtggcttcccctggtaaagaggaggcatgggatgaggagggaactagaggcatagaggaaatgccagctgtttacctcactttagtgtattcaggcccgtgtgctagttctggcctaagtcagccctatctgcgtgtgacctactttttccagaagacatacctgatttggtgatgggccaaagaggtgtggatcacacctcagcctggcattgctcattaagctaagaagcacttatagacactagtctgactgaatacagggttggccaagaatttaaggcaaacaaccttatctgtcctttaaaaaaacaaaaacaaaacatttaccagtatgtgtgcacgtttgtatagattcaggcgtgtgtgcattcgtgtatgcgtgtaggccagaagacaacctcaagtgtcattcttaagaacgccttttgggttcgttgagactgagtcattcattggtccagagttaaccaattagggcagaccttcaggatctatctctgatgcccagcgctgggcttacacgcatgtgctactgtgcccagcattttctttttttaatttaaaatagatttttttaaagatatatttctggctatgttttctcttcccccatctcctctaagatcttccctaactcccctcctacccaaatccacaccctttctctctctctctcactagaacacaaacaggcactaagaaacagtaataagataaggcaaacaaactggaataaggtgaaatagaccaacagaaaaaaaaaaagagccaaagagaaagtataagaatgataatatatttgccagcatttttatgtgagttctgtggatgggagctcaggtcctcatcgctctcacggttgaaccaactgcccagactgcatctgtcctttcattgtcatcattgttgttgttgtttggttattgttgtgtgtatatggtattggggcagcgcgtggacatgccgccgtgtgcacgcggaggtcagagggcagcttcatgaagtcagttctctgctctctaaggattaaactaatgttgccaggtttcccaaccaagaacttttatctgtggcgccatctcaccatcccctgtttttgttttgtttttgttttaagacaaggtcttgtagtctaggctagcctgctacttgctgcagtcagctgagggtcccttgaactacttaccttcctgcttctacctccaagtattaggactgtaggtgtgtgctgccatactaaggtctgggtttgttttttgtttgtttatgagtcaaaaagtcgggctggtgagatggctcagtgagtaagagcacccgactgctcttccgaaggtccggagttcaaatcccagcaaccacatggtggctcacaaccatcggtaacaagatctgactccctcttctggtgtgtctgaagatagctacagtgtacttacatataataataaataaatctttaaaaaaaaaaaaaaaaaaaaaagagtcaaaaagtcttactatatagcctaaaactggccttgaacttactatatagcccaggctggtcttcaactttcaatcctcttgcctcagcttctcaagtagttctcagattacatacgttgcaccactagacttgtatctgtgcatcttgctcaaatattttagtcctatagattataagaatgaataacagtatctggaaacattctcatattaacctttaacctttttttttccatgctggggaccaaagccagagccttgagcacactaggcaggtgtgtgtcactgagctacaccacctattgatggtactgttgatctgagaatgagaaatggaaaatgatggatttgttatgacatcagatgttataacaaccccttgatggtggattctgggggtatacgttttagagtcctattattactgcctttgagagaatgtcatccaaactggcttggaactctctaggtagggaaagctggccttgaactcttgatcctcctgtctccaccaccccgtatacagatgtgtgctctcacaaaacgctctccaaattactcatgcagcttacctcctcttcctagggcatatgcagccagcaaagagtcacatgccacgttggtgtttcataatctcttgggtgaaattgaccagcaatatagccgattcctgcaagagtccaatgtcctctatcagcacaaccttcgaagaatcaagcagtttctgcaggtgcggtgggaaatggatgtgagacggcagccccacagagtggagtgctgatgttcctgcccggaagttttccttacttggctaagtgacgcctgtcttgtactctaaatcaaaggagaagtaattagctccttctcaattccctgtacactggccctgggcaccattaccagaaattcacttcttatgttacagttgcagcaataagcaagggcttaatgttattctgttataaaagcacactattaacacctacttgtcataggcacatgactctcaggtctaaatgttaaaagtttagccattaactgggtactcctgggtaaagtcagtcatttccctataaagtcagatgacccacggtgccaggatgacctcacacttctggcttctgccatcacagaggccacatgctcctgccttcccttccctccccatggatttcagtcagatgctgaagcctttgatctgtggtttcatggaggctctgaggaagtgacttaagttagccaagttcactccacacctccttagccggctatagcttcctactctccatcttgcttacagagcaggtatcttgagaagccaatggaaattgcccggatcgtggcccgatgcctgtgggaagagtctcgcctcctccagacggcagccacggcagcccaggtgagagcaagaagaagcaaagtggcgagcaggggactgggaagcaagcgattgtataaataagtggaacagtaatggtttagtgcctctgaagaggagatcactagactacattaaagccctaaacatacattgaaaatgacaaaaaatttcatacagtctctattccactcccaaccaacagtgttgctgaagggtgaacttgagctcagattcctgagggctgggagttgaggtgctcacaccacatcctataagtgaggtgctaggggcagaaccagggctgcctgcgtggtggacacacactcggagacatattcccaaccccggattgttgatgttgttgatcgggttcttgctatgcatagctgacttccagtttgggataatcttcctgcctctgccacccaagtgcaggggtttcggtgatgccaccaaacttcccacacgtccatttcttgttttcattttcagcttttgagatggagtcacagtctgatacccagctgcctagaaccctgtgcgtgggctgagccctttcaaacccacaccagtcccttgcttcagtctctagtcattgagattttaggcatgggccaccaggctcagcttccttttgagacagagtctcaatacatacccccatatggtaaactctagatcctcctgcctcagcctccctgtgagccaccatgcctgatccacagggacttcccagtgcctgacccctgagttagaacttgggagttggcaaagcacacctccctagcaatttgtacggagcttgagagactctagaccactgcttggggaacatagaggtggtttttagggacaaagccttcattcttgccataggcaagtttaggagataggagataggagagggagggacccagctttggggctgggcactgtgaaggtctgtctgtagtacttctttatgtcttatcagtcagggtcgatcccacaggggaaaaatgtagtggctgggttgtttttccaagtcttctgagaggctgttatactatagtttgagcatccatgagaagtgggaagagcgcctgtctctaaaatgcctgttcagctctactttggagactcgtggtcgtagtagagagaacagaccagaagtgagaggttgtagaagcaaaggtctgggctggaggacagacctggcttcagttcctagcattcaagaggtggctcacaaccatctgcaattccagttccagggaatccaacacccatttgggcaccaggcacacatgctggcaaaaacagccacacacataaaatgaagtaaataagtctaaagaatagaaaacaaaacaaagtaaaaagaagtaaaaagccggcagttggaacctgactggagcccttgaccagtgcgatgggtgtgagggagtggttagctgtaggcccagggtgtgagcatttctagctttgaaaactggatggataacatctctccttatcatagtcttcaagatcctcaggctgctgtcaggctatctggttggttcttaaagcatctacttgttagtttctgctcccagcaaagccccatcattttacctatgaccccttaaggcattagcctctccgggctgggcagaagccttggaagcacaattttaaaagtccttgggaaatgttttttcatggaaatatgttacactttgttgtcatcagttcttaatttatttattaatattctctgagcactgggatcaagcctgggcttcactcatttaggcaggatctccagtactgagctgtaccccagctctttctagatttttttttttttttttgacagtttacctttaggctgcttgaaggatgaggcatcttagttcaacatgtgggctcctggtttaatgtggagaatgggtttgcagtgtttcctgttgataaaaagccagtggcacagagagaacagtgcaagcaccctcccagcaccctcccctttggatgggatggagctcagacgagagggttccacaaatccatgtgtgtgctaatcttagttatttattatttatttatttattggcagcaagggggccaggccaaccacccaacagccgccgtagtgacagagaagcagcagatgttggagcagcatcttcaggatgtccggaagcgagtgcaggtaatcgggcctcacccagggagccgcgctgtgctgtgcggctgcagagtgtggtcctgcgtgcacgctttcattatcttcaaaactttcttttccctttttcccaaaggtaacctgtgttttacttctgtttttggttggtttgtttgtttaaacaggatctagaacagaaaatgaaggtggtggagaacctccaggacgactttgatttcaactacaaaaccctcaagagccaaggaggcaagcgagctgtggggacggggcagtctgtgcaaggctacgccgtgtcactgagtctcagggcctgccttccatggtaggaggaggagctgctggcccttcacgggacaatttttgcattgtttgtttttgagatgggatttgaccatgtagctctggctgaccgtgagcctacaaccatcttacttcagctctctgagtagccgggactgcaggcgcacagatggtgtagagccttgttaagaaggctgtggtgagtccctctgctcaaggagtctttcctccttcccttagacatgcaggatctgaatggaaacaaccagtctgtgaccagacagaagatgcagcagctggaacagatgctcacagccctggaccagatgcggagagtaagcgatctggatgcttcctgagcatcgcacgcctagcgtggaagacagtttctgatggcttctttctctagaactgactagagactgcggttagacatgggctggggtaatgtgttctgacttggttttggtttccaaacagagcattgtgagtgagctggcggggctcttgtcagcaatggagtacgtgcagaagacactgactgatgaagagctggctgactggaagaggcggcagcagatcgcgtgcatcggaggccctcccaacatctgcctggaccgtctggaaaactggtaagagttggaagaaaggcttctttttctttagtcacgggcctgcaaggggggggggggggggcggggcggagcggggcggaggcggggcatgctgctccctcgccatgcttttgcttttgcttttgcttttgctttttcatgctggggtggatgtgtggtagacaagtgtgccagagccactggactacactcctagtgctggacactattgctaagatggcacctttttttttctttgagaaagaatctcactgagctgcataggctggccctcatacccactccatagcccaggctggccctcatacccactccatagcccaggctggccctcatacctactctatagcccaggctgaccttgaatttgcaatcctcctgcttcatcttcccaaatggaattatctgggattataggcatgcatcactctgcctgccttaaggtggccttttttacacagtcaagtttagtccaagaattaaaaccattacctaattttaacttttttgtttttttctgagacagagtttctctatttagccttagctgtccttgaacttgctctgtagactacactggctcaaactcatagaggtctgcctgcctctgcttcccaagtactgagattaaagacatgcaccaccattgcccaaccaacaaatttttaattaaaaagaataaattaataaagcttagatcactaatttaagatatttaaataatactttcagttgtatttaacactaaattctccattttagttattttaataatctaaaacaatatatgttatttgcaaaggggggaaataactgaatatatataaaactaataaaatgaaataaaaaaaatgaaaatctagtctttgagtagtaccagcaagtcaccagactttgtgatagtcattttgtaggcatctgtcgtgattaaacatgtgatttcatgactatacatgtgatgtcataactatacatgtgaagctagaaatcgagttgtccgtctccttcctcccttccttccttccttccttcctttgttgtggtgggatggatgcctcagggtccctttgcttcagtctcctgagtgctggggtcaccactaggggacagaggtgactggaacttccttccattatggcaggataacttcattagcagaatctcaacttcagacccgccaacaaattaagaaactggaggagctgcagcagaaagtgtcctacaagggcgaccctatcgtgcagcaccggcccatgctggaggagaggatcgtggagctgttcagaaacttaatgaagaggtaacttgtaagagatgacgttccgaagggaggaaccggcagaagactggtcaccacagcgtctgagatgccatccttttcccttccagtgccttcgtggtggagcggcagccctgcatgcccatgcacccggaccggcccttagtcatcaagactggtgtccagtttaccacgaaagtcaggtgggcctgtccttacactttgggtggagttttgattgatgtccagtcctcttccctgaggattttaagggaaggaaggttctgtggtgccatagctgaggggccccattgggtgagagatgaagcccactcctcacctggctcagaacacgtgcagtatttctcattgaatgctttttattgccttcccgtgagaagtctcttacaacttgcttcacatgcttaggcatctcagtactttctagctgaagggttagtgttcacttttaatgtcagagatgactctgcggaagtagaatttgggtttgtaaaaataatatatatatatatatatatatatatgcgtgcgtgcgtgtgtgtgtgtgtgtgtgtgtgtgtgtgtgtgtatttttcatctagacaggtctttgtagccctggctggcctggaacactctctgtaaactaggctggcttgaacccagagattcacctccctttgcctcccaagtgctgggattaaaggcatgcaccaccatgctcagcaatatttttacatcttaggaattgaagtattagggggtttatattttaacgagatcaaggtagggagcctactaactttccttgactatattttttaataggttgctggtcaaatttcctgagttgaattatcagcttaaaattaaagtgtgcattgataagtaagtattctttatgtgtgtgtgtgtgtaagtgtataatttttattatttaaaagcaactgttaaattcatgctttgctcatattcttcccttctcccaagtacattcagatctcctcctcctgtactcacccaagtttctcaaaaaaactaaacaaccaaaaccccaatacaacaaaatccccaaaagactgagaacaaaatacaacacccaaaaagaaaaaagatgggactaaaattgtgattaaataagagcatgcacaacaaactatttgttggtcaactgtcctgctcacgagacccgcactgagtggttgacaaagccagtgctgctcccagcagctccattgctaatctttcaccctagtggtgggtttacattcattcattcattcattcattttttttaatgtaacaaaataaaatataacaaagcaaaacaaaggctatgacatccaagttggacgagacaaaccaacaggaggaaaagaacccaagagaaggcacaggagtcggagtcccactcgtttgcaccctgggaatcccatgagaacactacatgggaagccacaatattagcacagaggccctggtgcaggcccctgcaggcccagggcatgctgctccagtctctgcgagttcatatgagctttgctcgtggtgattcagagggccttgtggttttggtgacctctaacccctctggttcttaatgttttttctgctgcttcttccttggtattccctgagctctgaggggagggatttgctggagacatcccatttagggaatgagtgtttcaaggtctttctctgcatgatgtctggctgtgggtctctatatttcttcccatctttggacaggaggactcttctctgatgatggctgagcaaggcactgatatctgagtctagcagaatgtcacctggagtcattttattgtttttttttcctttctcttttttagatcagtattatttagtttttccctaggtccttgggctatctagtctctggttcttggccacccaagccttgttgggtatgagtttcatcttgtatagtgagccttaagactcttgttggttggttacttccacaggtttgtgccaccattgccctagcatatcctgcaggcagtacactattacagatagaggtttgaggctggcttgctgttcacacttctcttttgatagcatgcagagtaccttcctataacaaagactctggcatacagtggggggctctatggaggcaccagcttcacgtgcccatgttcagtgagttgtgtaggtgttatcctcaacagtggggccttgctgtcagttgtggaaagcaaccgatggtcttgataacagcgtggattgtttgaggattccctttggccaacaattcaattagacttaaccctaacccagtactggaagctttatttggtggcaagagatcgccagttgggaccccaactctcccccattacttggcgattgaatctagatcaccttcacatatgtgaatgttttaggaggttcctactgtacgagatgtcgatactactccacggatgctccataagtgttgccgtctcccattgttccctcccaccaccagctctcctctcccctcggcttccccatttgctcctccaagttcagacctcgtctatccagaatccctcatctatccagaatccctcatctatccagaatccctcatctatccagaaccccttctatttcttttttcctaattagatctatttgttctctgtagttccttagtctgtattcaccctctgtggttcttaaggattgcagcttggttatcattgacttaatggctaatatccatacataagtgagtacacaccacatttgtctttctgggtctaggttacctcactcaggaagattttttttttcctagttccatctatttgcctgcaagtttcttttttttttttttaatggctgagtaatactccgtatgtaaatgtaccacattttctttattcattcttctgttgagggacatctaggttgtttccagcttctggttagtatggagagaacagcagtgaacgtggttgagcaagtgtctgtggtaggatgaagcatcctttgggtatgtgcccaagagtggtctaactggatcttgaggtagatggattcccgtcttcctgaggagcggccatactgatttccatagttgctgcatgagcttgcattcccaccagcaatatgtgatggtggcccttactccacatcctcgacagcatgagctgtcacttgtgttgatcttaactatcctgttaggcatatgatagactctcacagcagtttgatttgcattccctgatcctaaggatgttggacatttctctgtttctcagccacttgggtttcctctattaagaattttctgtttagatctgtaccccatttctaactggtctgtattttcttgatatttattttcttaaaattcttttcgggcatttgtcctctattggatatgtagttggtttaaaagaaaaatcccgttctgtaggctaccaatccgtattcttaagcctaactcttgttttcaaatgagggatggagaagcaagaacttggacagacatttgactttagagatgtctccattcagggatcttctttttgtgaacagctgtgttcaaaacccttgcaaaccctgcccggtttgcctgaagcattgaaaagaaaagtttgagtgtgtgcagctcagtattgcaggctcacctagcacgcacgcatgcacgaggcccgggttcaacccccatactgaaaaataaacgtgtaaataagtaatgcttgaaaatagagtatatggaaagagaactggtttgaagttaataatcttcttccacaaacccaccaacacatgctatttgtaggtaaaaatatagcaatggaaaagaaattttacttagttttattttgagagagcgtctgactctacaaccctggctggccttgaattcacagtgactcacctgcctgtgctccccagtgctaggattaaaggtatctgacaccaagtctggctaagaagaacttgtaaaatagtgttctgaaataagataaagacagaaatgtcataatataaaaagatggcctgtcagagacaggcagcagtggtcacgtgaggatagcatttccagctgccttgtgggaggtggtgtcagtttttggtaacaacatacctttctggaaaacccagcgtggctccgataataaggaaattcaccacccgtgtaactggaaatgcagttggggcaagtacctaaggatgaggctggtgactcacaggtgtcttcaggaaccctgggtcttccatgccatccttaccgtgccatccttaccgtgccagctgtagacaggttcccttccaggtggtctcatggctgtggacagaagatcagcctaggctattgcctccttggtctggctgagaacaggcctttaatcccagcacccaggaggcagaagcaggtgatctctgagttcaggtctacagagcaagttccacgacagccaggagggctacacagagcgctgtctcggaaagccgacaaaacagacaaggcagaccccgtcttcacctgctctgtggcttcctctgttctgatgaatgcagtgatcggggttccctggagatagatggctctgccatcccttactgagagaatggagctttccttaggaagggaaagaagctgtggttaggcccccagctaaggctactgtttaagtgcatacagagttgtgtttcacaccgaaaatgtaactgagcatcgaaaggcatgttccatcagagtaggttctggaaagaaagaggggctctaatctcagcttttattaacccttgtctgtgttctttacagagactctggggatgttgctgccctcagagggtaagttgggcctccttttgttctttctcatccaactttaccctctggctactcagcgctcactgtgtgttggtttttctcccatgatttaggtctcggaaatttaacattctgggcacgaacacaaaagtgatgaacatggaggagtctaacaacggcagcctgtctgcagagttcaagcacctggtcggtgtccgaggggagaggaggcggcacaggccaggtggcagaggaggggggagagactggcacagcctcaagtgacacttgcctccttcttcttcctttcttccagacccttagggagcagagatgtgggaatggaggccgtgccaattgtgatgtaagtaagttttgttcgggctaaaagcaattgttttctttctttgaggaagaaagagaaagctctctcgctctctctctctctctctctctctctctctctctctctctctctctctctccctctctccctctctccctctctccaacccagaattaaaactttaacccactacttcagatgtttgtcctttagaaaagttggtcgctctgggccagggtgacatgctcagaagtcacaggtgctgtggagttttctagcgagaaacatttccctgagtgttggggagttggctccctttcagcagtgggaagtccctcgccaagctgttacccacacccatctggtagaaaagaagtttccacattgcccggggcttcccagagtcccttgctactacctgccagctggctcccttttcagtgcctggtgagacaaaaggaagacatcaagtcagccagtcagagctaaacagaaaaaaaaacaacaacaaaacaaaacaaacaaaaaaaaaccaccaaccaaactgtgctcaggagctgaggcaggggaattgtgagtttgagatcattctgtcattcagcacatacatgtaaaagagctggaaattcattcctgagaattcatcagtaatttgtgtactaattgatgagggtctgtggtcccgtgcaggtcccagttcctctttcagagctgtagagtattctgctgcctacaccacagctcatgaccacaggtagccacattgcttgactgcttgtgtggcactgaaggttatcacagtcactttagaaagtgacttggcataaaaatgagcacaccctgtaaaccggcagttccagtcttaggaattaacagtaaagaaagctttgcataggtgaactaaggacagataacacagtcacagccattggtcattgacacagctcagatctctcagcactggggtcatgagctgtggtgtaggcagtggagtactctacagctctgaaagaggaactgggacctgcacgggaccacagaccctcatcaaggtgggggtggggtgtcaggagcaggaacacactgagagtgcagttcactgtgtgaagtacacatgcttggagaaacaaccatgaacacggttgggaggagctgggagacagcagagacaaagacacagtaaagtgcagagaagggggattcacctggggaatctcggtgataatggcaacttatgcgggatgataatgctaggctatcgctcagtgttggggtgcacttagatgcatgagaccctgagtttgctccctagtgcatataaaaggaaggagggagagagagaagaaacctaagaagccttcctttattccttcctattctcccctccttccttccctttctccctccctcctttcctctctcctccctctccctccctcctccctctccctccctctccctctctcctccctctccctcccttcctctctctcccctccctcccctcccttccctcttcctccctcccttccttcctccttcctctttctctcccctccctccttctccctccctcctccctcccatcctcccttcctccctccctccctccctccctccctccctccctccctccctccctccctccctccctcccttccttccttccttccttccttccttccttccttccttcctgtgtgtctgtgtttgtgtatggtcgcacatgtgcgatggtgtgaatgtgaaggtcaagttgccacttgaaggacttgtttcttcttccaccaagtgggtcccagggatgaggctcgggttggcaggcagatgcccttgcccactgagccatcttgctggccctcaaataaggacgtaagctgggtggcttatccttggatgctcattgctttgttattcttcgtgccttgaatgtgtattgtaagatatggttatgtactatgtagtgcatatgtgaggatcatgtccttgggtctttgggtggaagaaagagggcagagttgtgtccctgccagtgtctctgagagaccttatgctgttgcaggcctccttgatcgtgactgaggagctgcacctgatcaccttcgagactgaggtgtaccaccaaggcctcaagattgacctagaggtgaggccttcccagaaccaggcggctcgtgtgcgggggtgcgtgtgcagggaggccaggacagaacgcctgccgggatgatggctgtctgcccagcctggatttgtttctcattatctatctcagaaacgtccctgagagccaccctgtccccaagagtaaagtcttgcttgagtacctgttatgaaaatctatattagtgattgtttagaatcgatttgatgaagtttgggcaagtgggtcttagtagccgccatttagattttattttcctgcttgcttgcttgcttgtttccttccttccttccttaaagatttatttattttatgtatgtgagtacaccattactctcttcagacacaccagaagagggaattagattccatcacagatggttgtaaagccaccatgtggttgctgggaattgaactcaggacctcaggaagaatagtcagtgctcttaactgataggccatctctccagcccctgttttccatctttcttgatcttattaagtttagacctggaaaagcagacatccttaggtttgatttctaacacctcagcttcatggaaagatgcaggttgtttggaggttgccttccaggtctgtctctggagagtcgggctgagggcctgggttagccttagtgtttgggttagtgttagttgtttgtttgtttgtttttaaaggtttgtttgtttatttatttattatgagtgcactgtggctgtcttcagacactccagaagagggagtcatatcttttttatggatggttgtgagccaccgtgtggttgctgggatttgaactcgggaccttcggaagagcagtcagtgctcataactgctgagccatctctccagccctagtgttagtttttagggcctgactttgaacaagtcactgatgatgttcagacatcagtgctgatgcaggctggtcctgatgcaggctggtcctgatgcaggctggtcctgatgcaggctggtctttctcctcttggtgttcttgctccagcctgcacttgccgtgaggggtggccatggtgtgatttttaattctaacttattgagatgcgggtgacaagggttgggagctgtgagagcccagctgtcccactaagtcattcaccgcctgtccccatactctacagacccactccttgccagttgtggtgatctccaacatctgtcagatgccaaatgcttgggcatcaatcctgtggtataacatgctgaccaataaccccaaggtgagtttcccacccccaaccctctctgaaatccctgaaccttgctgcttctccacccccggtgcaggctgtcagtgtcactctctcatccaagtgggtgcaggctgtcagtgtcactctctcatccaagtgggtgcaggctgtcagtgtcactctctcatccaagtgggtgcaggctgtcagtgtcactctctcatccaagtgaacaaatgtgttcttttcaatagaacgtgaacttcttcactaagccgccaattggaacctgggaccaagtggccgaggtgctcagctggcagttctcgtccaccaccaagcgggggctgagcatcgagcagctgacaacgctggctgagaagctcctaggttgacagcttcagacatgtctggcctggggggtggtcattcagtcggggtccccatgtcagcctagggcaaggcaccatgccaggaccaggttgctaagtgtgtttgaagagcatgtttctttctttaaaaagccaaagacaatagttttaaattttttctcccctttaaaaaaatatctggactgaaagtaactttgacctgtgctcctacaaaaaaaaaaaaaaaaaggctcctgaccccagctgccagctttgtcactgtgtgttgccagttctcagaccacacaaggcaaggacaagcaggggtccaacaggacatctgtgctggcctaatctagggacagctgttgggcttgggtgtgtgtgggcatgtgtggcacacaccctgtaagtacatgtacaaatgcatggcctttttgtaaattctgcttaagaaatagctttggccaaggctgaaatccggttgttgttttctcttccagggcctggtgtgaactactcagggtgtcagatcacatgggctaaattctgcaaagtaagtgatcctgttgattccctcagttaggaggtaggtgtggggtgcccaggacccctttctccagcagctgtcaggagctgcctgaggatagaggaacctgagggtgtaagaaggctctggcaggaaagagctggggtgagtggtggtggacttgctttcccattcttttctccaggaaaacatggctggcaagggcttctccttctgggtctggctagacaatatcatcgaccttgtgaaaaagtatatcttggccctttggaatgaagggtaaggttaaactctgcagtaaggctgccctgtgtaacgagtcacctactcccagcaagcccgtgactggttgtccttggctgcaggtacatcatgggtttcatcagcaaggagcgggagcgggccatcctaagcacaaagcccccgggcaccttcctactgcgcttcagcgagagcagcaaagaaggaggggtcactttcacttgggtggaaaaggacatcagtggtaagaacgcttgcctcctgtatcacttgctccacctgctggccactggcagcacccggctacttcatgttctgggtactactgccccctgaagggcagagagggcctgtgcctcctgaagaggtggcctgccagtttgtcctgttcactcatttggctaacatttgtgtagaaaagtgtgattgaaatcttacttctgtactccctttcctgcctaccccgttaatacatttgcggcaggtgtttttgcctatgagccagctggatctctacaagcccgcctggatattgcctcagttccaagtcactgggcagggcattcagagtctccagcactcactccactggcataatctctccttccatggtccgtgacaggcaagacccagatccagtctgtagagccatacaccaagcagcagctgaacaacatgtcatttgctgaaatcatcatgggctataagatcatggatgcgaccaacatcctggtgtctccacttgtctacctctaccccgacattcccaaggaggaggcatttggaaagtactgtaggcccgagagccaggagcaccccgaagccgacccaggtagttgttgactttccatggctttgccttccttcctagtgagaaagtacgcatccttggagagacaaggacatggctgagtatcttgtgggagcagggcttggtgattccttcttttgggaaagagtggtttattgggttccttgacagggtgactaactcaggattcaagaggaggacagaatcagccctcagggagcttggaagtctgaagatgaaaatagtatctctccctcttcctctcttctccctttccatctccccctccctcccaccccgccactttaaaacactagaaagagaaatgaaggcaggtctctctggtgcttctccagtcagtgggttccagaagacccgagacagatttgagtccagcatgctttgctgtcctgagtgagcagtgccaggagtctgaagaaaggctttctggggcagtggctgttggcagcctggggcagagctgacatcaagctggaggtgttgatgttccagagatgatgactggagggaatgtggacttggcatttagaaacaagatgcatctactctgtgggagtgcgtgtggctgtaaatcagcatttctcagcctttcacggagcgcttaagactataggaaaacagagatttccattatgattcataactgtagcaaaattacagctatgaagtagtaagaaaaagtaatgtatggttggggtcaccacaacatgaggagctgtattaaagggtcatagcattcagaaggttgagaactgctggtataaattatatgaaaaatagaaattatgttgtgttaagtctgtagtgtctggggcggtcccagtgtaaagagtcagaggtgtctggtctgaagccatttcaaacttgttgcattgacgcttgcctctgtccttatgctggtgaggagtctggttttctaagactgttgttgatcattgcacatgctgagctccgaggtgccctgtgtgagccggcctccttgctctgaggtgccctgtgtgagccggcctccttgctctgaggtgccctgtgtgagccggcctccttgctctgaggtgccctgtgtgagccggcctccttgctctgaggtgccttgtgtgagccggcctccttgctctggtgttttttcaccaaccgcttctgttcacatagcacctgcacacagcttccccggctctgcccaccattcttggaggagtcgcttgttgacggttactttcctttccctttgttctgctgttgagttctcttcattctgtggaggagttcagctctcacttcctgtctgtcccttatctctgcttccaccttgccttcagttggaagatctgtttatcagtccctctcacactggtctttgttcttttcacagaggactttgaagtccgagcactgatccttttgactaattttgctttcaagatccaggcccctggtcaggcatccacctccatcaccattcctgtgtaggctgcccagagacattcctcaggggcaaggcctgggcatgagaaaggagcccactgcctgatgggcttgcctgtgagcctagggagagtgcactgggggctccggagcccgatgatggaagggtagggggttcagatgatccccttagggaggtgagcctgtatgtccctgtcctctgcccctgctacaggagtattgcagtagagacctccccggagcctcgtcctgggtcttccttgtctgtcaggaggctgtaatataccctgtgctcctctggagggattttgagcaagttcaccaggcagcaacaggatgttccttctctcttccatctccagtctgtgtcccgcactcctacctcgggccgggtcaaagaatatttctctcttgaccactggagaatgaaagtcttctcttctccgctctaacttattgtgtatgcatgtgtgttgggggtggtccttgttggaggaccttgagggtgtcagctctctccttctaccatgtagcccctgaggacagagctcaggcttggtgacagatgacttaagcactaagccatctccctgatcccctctgtctctttaaggtgacagttctcactctagagaccttttctagaactgtaggcagcacagttgcctcaataattcctttgcttctgtgctgagttaacctgtttcttggccacaaatgagcttgcatattcatctaagagcactttctaatggcttctcccaggggtttgtcttgctggatgcttgtaagccccagtgttctgtctgtgcttttcttagcctacccacacagccccaggcccgctgcgagcatcattaactgaacccccagggcttcatgccagtgtccccagggcttccagatttcttggcctaacatttcagtcctcacatttccaacataaacggcagagatggaagacagccagtcctgtctctttctctgtcccacacatgaaagagatggcgccttggccaggtttcctggctgttgcacatgttctcggacctggtgtcctgtctcccagtggctggggtatgttttcctgattggaagtggctttggagcctccagcacgtaagcatttagtcctgttggtgtctgggctggtcaccaaacagggaagtcaattcacaagtgtgaccaggtcacaggagaagcctaacgctacacaaagatggttggtcgctcaggcagggtggggaaggatgcacaagagttggcggtaggccgggcagtggtggtgcacacctttaatcccagcacttgggaagcagaggcaggcggatttctgagttcaagcccagcctggtctacagagtaagttccaggacagccagggctacacagagaaaccctgtctcaaaaaaacaaaaaacaaaaacaaaagagttgacggtaggctgggtagaggtggggcaggtgtctctgcagaagtctttgcagctcaggaaattctatggaagagatagaacttcaaactgcaagactggatggcaagcagcatgtgatgagggaggacagccctaagagctggactgcggtgtctgggcagtttctgtaaggttggctcacgccgtctgggagaggcaggaggattcctcttgcatgttctcaaagcaagtcacaatctgttaaagcccgggtttcctctctgcaggtgctgccccgtacctgaagaccaagttcatctgtgtgacaccgtaagtggccgcccttcccagtttcgcattcatttctagtgtcctagtgtgctcagttgtccccaggaatagggaggacatggggtgagagttaccgtgaagggctggtagctgctgggcttgtttagtgctcagagtgaccttgtgtgtttaaaaagcttgagtttttattttttctgttggagaccagagtttgatggcttgtgtgtgtgtgtttgttctttttttttttccccctccattgtgtcttgtcaacctggcccttcccactcctgccgtcccccctttcctacagaacgacctgcagcaataccattgacctgccgatgtccccccgcactttagattcattgatgcagtttggaaataacggtgaaggtgctgagccctcagcaggagggcagtttggtgagtgtttggagggtcaggccccattgatgcttgcctgtacagagccagggcctgccatccacactggtagaaatcggctctagagctgggtgtggtggcccaagcctgaggcagaatgatccctccctgtgagttctgaggccagcctggtctataaagtgagtccaggatagccggggctctattacacagagaaacccagtcttgaaaaaacaaaacaaaacaaaaaatggctctagggccatgttctgctgtggaaatgatactcacacacatgcagtttcccagtagccacagtaaaagcagtaagagactttgacagcttgggtaagcagcagcggcacttcagcatctgagaaatcatggagctgtcctcccctgtcccgcctcctctactgagtctttgaaatggagtggctttgatgcctttgatttaggctagtctcaggtggcagtgtgtggctaaggctaccacacccagggcagcctcagacccctgaaagagagagtgagggctgaggtggagactgtgctcttctgggagggcaaggccctcctgtgaggggcaggaagtctggcttttctgaccttgtccatgtctgaaggaacaggagactggtggttcctgagccctgtcctcgtacagagggatgagggtttgtgagtcggctttagtcaggtggctgaactgacactctctgtgtgtctctgcagagtcgctcacgtttgacatggatctgacctcggagtgtgctacctcccccatgtgaggagctgaaaccagaagctgcagagacgtgacttgagacacctgccccgtgctccacccctaagcagccgaaccccatatcgtctgaaactcctaactttgtggttccagatttttttttttaatttcctacttctgctatctttgggcaatctgggcactttttaaaatagagaaatgagtgagtgtgggtgataaactgttatgtaaagaggagagcacctctgagtctggggatggggctgagagcagaagggagcaaggggaacacctcctgtcctgcccgcctgccctcctttttcagcagctcggggttggttgttagacaagtgcctcctggtgcccatggcatcctgttgccccactctgtgagctgataccccaggctgggaactcctggctctgcactttcaaccttgctaatatccacatagaagctaggactaagcccagaggttcctctttaaattaaaaaaaaaaaaaataagaattaaagggcaaaacacactgacacagcatagcctttccatatcaaggaatactcagttaacagcctctccagcgctgtcttcaggctgatcatctatataaaccctggaatggttgcagatcaaatctgtaaaagagatccgagagctgtggcttggcctctggttcaaacacaaaggctagagagaacctagatatccctgggttttgtttacccagtatgcttgtcggttggaggtgtgaggtaggccaagggcactggaaagcctttgtcatcaccctactccctccccaacccagactccagaccctgtttcagggtcagcctgccctgtgggtgccttactgggcctagggtcaacctgccttcctttcccacttgaccttgctggtagtatgtccccttcccatgtccaaaggccctctgtcctgcttctattgggaatccctgcctcaggaccttgtgtcgagagggattgccttacaggtttgaacctgcctcagactacaggccctcagcaaagctcagggagtatggtccttattctatgcgcttggttcccagggatatctgtaaccacagggcaaaagctgacatatactccaggtctgccctcatatgagtggtgtattcttggcctcccctgagactggcaactgtctgctccccattgggtctcccaggtgaggtggaacacagttcctgcacctactgtggcctccatgtcgcttgcttgcttcgctcactcagcttactggaacactgagtgttcaaggcaagcctttcctgacagaggcatggctagattcagtgactcaaagccacctcattcagctgatcagtgtctgtggaattgtttccttccagttaaccagtgtctgaattaagggcagtgaggacattgtctccaagacgaactgcttgccttgaccaccccagccttctgcttcgagacagttactgctctcccaccccatcaatgttctttagttatacaataagctgaacttataaactgaaagggtatttaggaaggcaaggcttgggcatttttatggctttcaatcctggggacccaggaacaaggtgagggcttctctggggctggtgttgtacctcaggggctctgggaagtctgtgtgcctgggttaaccacccatagtgagcccctggaactgcccactttccctctccttggccccacttggccccagcctcacccagcctgcagactgcttagcctttcagtgcagtggcttgtgttctggccactgcactcagattccaatgtaaactttctagtgtaaaaatttatattattgtgggttgttttttgttgttgtttgtttttgtatattgctgtaactactttaacttccagaaataaagattatataggaactgtctggcagtgggggctggctggctggcgggaccacctttgcctaggttgtgcttggaagaggcagagccgggctaggagcacatgataagaggggatagagcagcccagctcggttgaagttctgtttgcttctcattcccagggtgatgcaggccccccaccttacatcagctaccgtcctccagaagaggtgacccaggagccagaggtcatagtccagtggcaggacagtgtcagagtggcctcctccctctgccctcccaaagctgctgtgtttgttctggagtcagataagctccctaatggagggcgggagggctggggtgtagaccaaggcctctccttccacagttggcccattatcaccttctttacagtggggacaacttgcagccacttccctggctggtggctacagggcccctgggcagtcagcaacgataattgaggaaaaggccacagacaaggcgcctgctcacagcaccccccacctactcctctccctgctcagtaccttggagcccagccctgcactgggtgcctcggtgagagataccagtgccgcctctgcagagatggaagcagggatcagtgttcttagcacgactgaggcagggccagaccctgcttccaatccccagccaccctgcctgggacaggctgtgaactgagctccttcccccaaacatgattggaactctgaggtaacctgtcttacagttcctcatgccccaaccctcaatcctcagtagtgtgccccccccctttttaaaaagatgtatatgagtacactggagctgtacagatggttgtgagccttcatgtggttgttgggagttgaatttgaggacctcggctggctccagcccaaagaattattactatacacaagtacactgtagctgtcctcagatgcgccagaagaaggtgtcagatcttgttacaggtggttgtgagccaccatgtggttgctgagatttgaactcatgaccttggaagagcagtcagtgctcttacctgctcactccagcccaggagtgtgctctttaagtccaaggctccaaccctgagtcctggactaattgtacctgggtgccagaggtccagctagggcaaggcaggcctctctgtcctgactagtttcctttgctttctcagtctatggcagcagttggctgatgtcacctgctaggctctgggaagaggccaggggatgaagggctgttgtccaggctctctaatgcccttggccacaggaaggttgacaggcactctggccctggcccctgtgattgcttagggggctgctggggaggggtagcctggactatagctttgctttcattcttgcaccttctttccccaagcccttaaacccctgctttcctgggcatgtagcccctaacacacacacattttcctgggcatgtagcccctaacaaatacacacatacaccacacacacacacacacagagagagagagagtgtttagctttctgacactgctttagggcagcagcacccttaagatcacagcagagggagcagagataactccaagctaaaattgggaacaaaacttcaactttagtgaaaagcccatccatcacacagcccagtaaaccaggaagcagactggtagatttgcaaaaaccaaaccaacaaaaactttattcaaaaacactgtttacataaatgttgagttctatgtacaaaatataaaaagcatccctctgcttccttcagagaggttggaagccaggactcctagtcggctcctcctggctgctctgtcacagcctccagggaagagctgctgaagcgatttctgagaccacaacccatggtgggacagtgcagggcccgttctaggtcttgccgcccagcagagtggagcagactgagcgctccccacccccttccttcagacagtgtgtacaggttttgtgtgctacaggtttttcgccccaggtttcctcctcccagacccccagtattcccctcctttctgatataataagcaaggttgcaaacaggaaaggaagaaaggatgaggccacgtgtggtcatgcatgcctgtaatcctagcactctagaaacaggtaggaggatcattcatggatagtctgggatatatggagagaccttgtctcaaaaaagcaaagcaaaaacataaaaaaaaaaaaaaaagcaagaaggatgaatccatctggaagggtgaggatatcgaatggagaaaagggatggtgggaacgtggacaaggccgttagacttgaatctcacgtccatccaccctggcgcaagaactgacactcggctgtggcagccctctgctgtgttgaagggaacagcttaagcacaccgagcaatcacaaagtctgcagcccgtatgtatacacaaaggtataaagggtcactaagatgaaccccaatcttccacctgtgcgaggacaggagcacaccggtctgggcgaagcttctagcttaggagtaaaactccaacttagttgcctaaacctgcctccctgccttttctagaatttcactgaaatggccattggacagaaaaaggacaccggagaaataggtttgtcagcaatgataggttcagctcttacacgagaggccctgggggcccttgaggtctgaacaaaaaggtcaccaccgctttagccacaaacccagaactgtgtgggcaaggtagccctgtgaaacgtgcaaagccattgttggtatgaacagagatactacaactgacgtgggctcctcacactgaaggtggttttccaagagaagcatggagtccagcgttcaggacagggagcttctagcggaggtgaagagaccagcaggtggggagaggcgggcgtcgagactgtccatgggccggcgtaaaagttcttccacgtgcctggcaacatccatgctctcatccaggtcaaactcgccatcttggtcaaggacagggtcagggctggcaaagagagggatgttggagaaactggcaggtctcatggctccaaacccccatagagcgtcctcaggctgctgctcacaaagactggagtctcctgaggacaggacccatggcagcctggcctggaactcccaccaggctggattggggaagataatctacttccattccactcttgcttcataccatgatctcagggcgttttccccttgcctgtac

SEQ ID NO: 4-5 - skipped (2 entries)

SEQ ID NO: 6 - DNA, 24 bp, Artificial Sequence
  Primer
acatgccactttggtgtttcataa

SEQ ID NO: 7 - DNA, 27 bp, Artificial Sequence
  Primer
tcttcgtagattgtgctgatagagaac

SEQ ID NO: 8 - DNA, 29 bp, Artificial Sequence
  Probe
cagtatagccgcttcctgcaagagtcgaa

SEQ ID NO: 9 - DNA, 16 bp, Artificial Sequence
  Synthetic oligonucleotide
tccaggatccggttgg

SEQ ID NO: 10 - DNA, 14 bp, Artificial Sequence
  Synthetic oligonucleotide
ccaggatccggttg

SEQ ID NO: 11 - DNA, 16 bp, Artificial Sequence
  Synthetic oligonucleotide
ggccgaagggcctctc

SEQ ID NO: 12 - DNA, 14 bp, Artificial Sequence
  Synthetic oligonucleotide
gccgaagggcctct

SEQ ID NO: 13 - DNA, 16 bp, Artificial Sequence
  Synthetic oligonucleotide
cctgctaaaatcaggg

SEQ ID NO: 14 - DNA, 14 bp, Artificial Sequence
  Synthetic oligonucleotide
ctgctaaaatcagg

SEQ ID NO: 15 - DNA, 16 bp, Artificial Sequence
  Synthetic oligonucleotide
attccattgggccatc

SEQ ID NO: 16 - DNA, 14 bp, Artificial Sequence
  Synthetic oligonucleotide
ttccattgggccat

SEQ ID NO: 17 - DNA, 16 bp, Artificial Sequence
  Synthetic oligonucleotide
ccgtgtgtcaagctgc

SEQ ID NO: 18 - DNA, 14 bp, Artificial Sequence
  Synthetic oligonucleotide
cgtgtgtcaagctg

SEQ ID NO: 19 - DNA, 16 bp, Artificial Sequence
  Synthetic oligonucleotide
actgccgcagctccat

SEQ ID NO: 20 - DNA, 14 bp, Artificial Sequence
  Synthetic oligonucleotide
ctgccgcagctcca

SEQ ID NO: 21 - DNA, 16 bp, Artificial Sequence
  Synthetic oligonucleotide
gactctcaatccaagg

SEQ ID NO: 22 - DNA, 14 bp, Artificial Sequence
  Synthetic oligonucleotide
actctcaatccaag

SEQ ID NO: 23 - DNA, 16 bp, Artificial Sequence
  Synthetic oligonucleotide
ttctttgctggccgca

SEQ ID NO: 24 - DNA, 14 bp, Artificial Sequence
  Synthetic oligonucleotide
tctttgctggccgc

SEQ ID NO: 25 - DNA, 16 bp, Artificial Sequence
  Synthetic oligonucleotide
gattatgaaacaccaa

SEQ ID NO: 26 - DNA, 14 bp, Artificial Sequence
  Synthetic oligonucleotide
attatgaaacacca

SEQ ID NO: 27 - DNA, 16 bp, Artificial Sequence
  Synthetic oligonucleotide
atactgctggtcaatc

SEQ ID NO: 28 - DNA, 14 bp, Artificial Sequence
  Synthetic oligonucleotide
tactgctggtcaat

SEQ ID NO: 29 - DNA, 16 bp, Artificial Sequence
  Synthetic oligonucleotide
gagaacattcgactct

SEQ ID NO: 30 - DNA, 14 bp, Artificial Sequence
  Synthetic oligonucleotide
agaacattcgactc

SEQ ID NO: 31 - DNA, 16 bp, Artificial Sequence
  Synthetic oligonucleotide
tagattgtgctgatag

SEQ ID NO: 32 - DNA, 14 bp, Artificial Sequence
  Synthetic oligonucleotide
agattgtgctgata

SEQ ID NO: 33 - DNA, 16 bp, Artificial Sequence
  Synthetic oligonucleotide
actgcttgattcttcg

SEQ ID NO: 34 - DNA, 14 bp, Artificial Sequence
  Synthetic oligonucleotide
ctgcttgattcttc

SEQ ID NO: 35 - DNA, 16 bp, Artificial Sequence
  Synthetic oligonucleotide
caagatacctgctctg

SEQ ID NO: 36 - DNA, 14 bp, Artificial Sequence
  Synthetic oligonucleotide
aagatacctgctct

SEQ ID NO: 37 - DNA, 16 bp, Artificial Sequence
  Synthetic oligonucleotide
gccacaatccgggcaa

SEQ ID NO: 38 - DNA, 14 bp, Artificial Sequence
  Synthetic oligonucleotide
ccacaatccgggca

SEQ ID NO: 39 - DNA, 16 bp, Artificial Sequence
  Synthetic oligonucleotide
cagtggctgcagtctg

SEQ ID NO: 40 - DNA, 14 bp, Artificial Sequence
  Synthetic oligonucleotide
agtggctgcagtct

SEQ ID NO: 41 - DNA, 16 bp, Artificial Sequence
  Synthetic oligonucleotide
ggcccccttgctgggc

SEQ ID NO: 42 - DNA, 14 bp, Artificial Sequence
  Synthetic oligonucleotide
gcccccttgctggg

SEQ ID NO: 43 - DNA, 16 bp, Artificial Sequence
  Synthetic oligonucleotide
gtcaccacggctgctg

SEQ ID NO: 44 - DNA, 14 bp, Artificial Sequence
  Synthetic oligonucleotide
tcaccacggctgct

SEQ ID NO: 45 - DNA, 16 bp, Artificial Sequence
  Synthetic oligonucleotide
tccagcatctgctgct

SEQ ID NO: 46 - DNA, 14 bp, Artificial Sequence
  Synthetic oligonucleotide
ccagcatctgctgc

SEQ ID NO: 47 - DNA, 16 bp, Artificial Sequence
  Synthetic oligonucleotide
atcctgaaggtgctgc

SEQ ID NO: 48 - DNA, 14 bp, Artificial Sequence
  Synthetic oligonucleotide
tcctgaaggtgctg

SEQ ID NO: 49 - DNA, 16 bp, Artificial Sequence
  Synthetic oligonucleotide
tctagatcctgcactc

SEQ ID NO: 50 - DNA, 14 bp, Artificial Sequence
  Synthetic oligonucleotide
ctagatcctgcact

SEQ ID NO: 51 - DNA, 16 bp, Artificial Sequence
  Synthetic oligonucleotide
ttttctgttctagatc

SEQ ID NO: 52 - DNA, 14 bp, Artificial Sequence
  Synthetic oligonucleotide
tttctgttctagat

SEQ ID NO: 53 - DNA, 16 bp, Artificial Sequence
  Synthetic oligonucleotide
ggagattctctaccac

SEQ ID NO: 54 - DNA, 14 bp, Artificial Sequence
  Synthetic oligonucleotide
gagattctctacca

SEQ ID NO: 55 - DNA, 16 bp, Artificial Sequence
  Synthetic oligonucleotide
agttgaaatcaaagtc

SEQ ID NO: 56 - DNA, 14 bp, Artificial Sequence
  Synthetic oligonucleotide
gttgaaatcaaagt

SEQ ID NO: 57 - DNA, 16 bp, Artificial Sequence
  Synthetic oligonucleotide
agatcttgcatgtctc

SEQ ID NO: 58 - DNA, 14 bp, Artificial Sequence
  Synthetic oligonucleotide
gatcttgcatgtct

SEQ ID NO: 59 - DNA, 16 bp, Artificial Sequence
  Synthetic oligonucleotide
tgtttccattcagatc

SEQ ID NO: 60 - DNA, 14 bp, Artificial Sequence
  Synthetic oligonucleotide
gtttccattcagat

SEQ ID NO: 61 - DNA, 16 bp, Artificial Sequence
  Synthetic oligonucleotide
tccgcatctggtccag

SEQ ID NO: 62 - DNA, 14 bp, Artificial Sequence
  Synthetic oligonucleotide
ccgcatctggtcca

SEQ ID NO: 63 - DNA, 14 bp, Artificial Sequence
  Synthetic oligonucleotide
tctccgcatctggt

SEQ ID NO: 64 - DNA, 16 bp, Artificial Sequence
  Synthetic oligonucleotide
tcactcacgatgcttc

SEQ ID NO: 65 - DNA, 14 bp, Artificial Sequence
  Synthetic oligonucleotide
cactcacgatgctt

SEQ ID NO: 66 - DNA, 16 bp, Artificial Sequence
  Synthetic oligonucleotide
ccgccagctcactcac

SEQ ID NO: 67 - DNA, 14 bp, Artificial Sequence
  Synthetic oligonucleotide
cgccagctcactca

SEQ ID NO: 68 - DNA, 16 bp, Artificial Sequence
  Synthetic oligonucleotide
tccagtcagccagctc

SEQ ID NO: 69 - DNA, 14 bp, Artificial Sequence
  Synthetic oligonucleotide
ccagtcagccagct

SEQ ID NO: 70 - DNA, 16 bp, Artificial Sequence
  Synthetic oligonucleotide
ccgcctcttccagtca

SEQ ID NO: 71 - DNA, 14 bp, Artificial Sequence
  Synthetic oligonucleotide
cgcctcttccagtc

SEQ ID NO: 72 - DNA, 16 bp, Artificial Sequence
  Synthetic oligonucleotide
cgatctaggcagatgt

SEQ ID NO: 73 - DNA, 14 bp, Artificial Sequence
  Synthetic oligonucleotide
gatctaggcagatg

SEQ ID NO: 74 - DNA, 16 bp, Artificial Sequence
  Synthetic oligonucleotide
gagattctgctaatga

SEQ ID NO: 75 - DNA, 14 bp, Artificial Sequence
  Synthetic oligonucleotide
agattctgctaatg

SEQ ID NO: 76 - DNA, 16 bp, Artificial Sequence
  Synthetic oligonucleotide
ctgaagttgagattct

SEQ ID NO: 77 - DNA, 14 bp, Artificial Sequence
  Synthetic oligonucleotide
tgaagttgagattc

SEQ ID NO: 78 - DNA, 16 bp, Artificial Sequence
  Synthetic oligonucleotide
aactttttgctgcaac

SEQ ID NO: 79 - DNA, 14 bp, Artificial Sequence
  Synthetic oligonucleotide
actttttgctgcaa

SEQ ID NO: 80 - DNA, 16 bp, Artificial Sequence
  Synthetic oligonucleotide
gtcccctttgtaggaa

SEQ ID NO: 81 - DNA, 14 bp, Artificial Sequence
  Synthetic oligonucleotide
tcccctttgtagga

SEQ ID NO: 82 - DNA, 16 bp, Artificial Sequence
  Synthetic oligonucleotide
aggcacttttcattaa

SEQ ID NO: 83 - DNA, 14 bp, Artificial Sequence
  Synthetic oligonucleotide
ggcacttttcatta

SEQ ID NO: 84 - DNA, 16 bp, Artificial Sequence
  Synthetic oligonucleotide
caggatgcatgggcat

SEQ ID NO: 85 - DNA, 14 bp, Artificial Sequence
  Synthetic oligonucleotide
aggatgcatgggca

SEQ ID NO: 86 - DNA, 16 bp, Artificial Sequence
  Synthetic oligonucleotide
tttagtagtgaactgg

SEQ ID NO: 87 - DNA, 14 bp, Artificial Sequence
  Synthetic oligonucleotide
ttagtagtgaactg

SEQ ID NO: 88 - DNA, 16 bp, Artificial Sequence
  Synthetic oligonucleotide
ccagcaacctgacttt

SEQ ID NO: 89 - DNA, 14 bp, Artificial Sequence
  Synthetic oligonucleotide
cagcaacctgactt

SEQ ID NO: 90 - DNA, 16 bp, Artificial Sequence
  Synthetic oligonucleotide
ataattcaactcaggg

SEQ ID NO: 91 - DNA, 14 bp, Artificial Sequence
  Synthetic oligonucleotide
taattcaactcagg

SEQ ID NO: 92 - DNA, 16 bp, Artificial Sequence
  Synthetic oligonucleotide
tttaagctgataattc

SEQ ID NO: 93 - DNA, 14 bp, Artificial Sequence
  Synthetic oligonucleotide
ttaagctgataatt

SEQ ID NO: 94 - DNA, 16 bp, Artificial Sequence
  Synthetic oligonucleotide
gcacactttaatttta

SEQ ID NO: 95 - DNA, 14 bp, Artificial Sequence
  Synthetic oligonucleotide
cacactttaatttt

SEQ ID NO: 96 - DNA, 16 bp, Artificial Sequence
  Synthetic oligonucleotide
gtccccagagtctttg

SEQ ID NO: 97 - DNA, 14 bp, Artificial Sequence
  Synthetic oligonucleotide
tccccagagtcttt

SEQ ID NO: 98 - DNA, 16 bp, Artificial Sequence
  Synthetic oligonucleotide
gaggctgccgttgttg

SEQ ID NO: 99 - DNA, 14 bp, Artificial Sequence
  Synthetic oligonucleotide
aggctgccgttgtt

SEQ ID NO: 100 - DNA, 16 bp, Artificial Sequence
  Synthetic oligonucleotide
ccctcagggtcaagtg

SEQ ID NO: 101 - DNA, 14 bp, Artificial Sequence
  Synthetic oligonucleotide
cctcagggtcaagt

SEQ ID NO: 102 - DNA, 16 bp, Artificial Sequence
  Synthetic oligonucleotide
cacatctctgctccct

SEQ ID NO: 103 - DNA, 14 bp, Artificial Sequence
  Synthetic oligonucleotide
acatctctgctccc

SEQ ID NO: 104 - DNA, 16 bp, Artificial Sequence
  Synthetic oligonucleotide
atcagggaagcatcac

SEQ ID NO: 105 - DNA, 14 bp, Artificial Sequence
  Synthetic oligonucleotide
tcagggaagcatca

SEQ ID NO: 106 - DNA, 16 bp, Artificial Sequence
  Synthetic oligonucleotide
gatcaggtgcagctcc

SEQ ID NO: 107 - DNA, 14 bp, Artificial Sequence
  Synthetic oligonucleotide
atcaggtgcagctc

SEQ ID NO: 108 - DNA, 16 bp, Artificial Sequence
  Synthetic oligonucleotide
atacacctcggtctca

SEQ ID NO: 109 - DNA, 14 bp, Artificial Sequence
  Synthetic oligonucleotide
tacacctcggtctc

SEQ ID NO: 110 - DNA, 16 bp, Artificial Sequence
  Synthetic oligonucleotide
tcttgaggccttggtg

SEQ ID NO: 111 - DNA, 14 bp, Artificial Sequence
  Synthetic oligonucleotide
cttgaggccttggt

SEQ ID NO: 112 - DNA, 16 bp, Artificial Sequence
  Synthetic oligonucleotide
tctaggtcaatcttga

SEQ ID NO: 113 - DNA, 14 bp, Artificial Sequence
  Synthetic oligonucleotide
ctaggtcaatcttg

SEQ ID NO: 114 - DNA, 16 bp, Artificial Sequence
  Synthetic oligonucleotide
ggagtgggtctctagg

SEQ ID NO: 115 - DNA, 14 bp, Artificial Sequence
  Synthetic oligonucleotide
gagtgggtctctag

SEQ ID NO: 116 - DNA, 14 bp, Artificial Sequence
  Synthetic oligonucleotide
caaggagtgggtct

SEQ ID NO: 117 - DNA, 16 bp, Artificial Sequence
  Synthetic oligonucleotide
actggcaaggagtggg

SEQ ID NO: 118 - DNA, 14 bp, Artificial Sequence
  Synthetic oligonucleotide
ctggcaaggagtgg

SEQ ID NO: 119 - DNA, 16 bp, Artificial Sequence
  Synthetic oligonucleotide
tctgacagatgttgga

SEQ ID NO: 120 - DNA, 14 bp, Artificial Sequence
  Synthetic oligonucleotide
ctgacagatgttgg

SEQ ID NO: 121 - DNA, 16 bp, Artificial Sequence
  Synthetic oligonucleotide
atttggcatctgacag

SEQ ID NO: 122 - DNA, 14 bp, Artificial Sequence
  Synthetic oligonucleotide
tttggcatctgaca

SEQ ID NO: 123 - DNA, 16 bp, Artificial Sequence
  Synthetic oligonucleotide
ttcttgggattgttgg

SEQ ID NO: 124 - DNA, 14 bp, Artificial Sequence
  Synthetic oligonucleotide
tcttgggattgttg

SEQ ID NO: 125 - DNA, 16 bp, Artificial Sequence
  Synthetic oligonucleotide
cccaggttccaattgg

SEQ ID NO: 126 - DNA, 14 bp, Artificial Sequence
  Synthetic oligonucleotide
ccaggttccaattg

SEQ ID NO: 127 - DNA, 16 bp, Artificial Sequence
  Synthetic oligonucleotide
ctcgcttggtggtgga

SEQ ID NO: 128 - DNA, 14 bp, Artificial Sequence
  Synthetic oligonucleotide
tcgcttggtggtgg

SEQ ID NO: 129 - DNA, 16 bp, Artificial Sequence
  Synthetic oligonucleotide
gctcgatgctcagtcc

SEQ ID NO: 130 - DNA, 14 bp, Artificial Sequence
  Synthetic oligonucleotide
ctcgatgctcagtc

SEQ ID NO: 131 - DNA, 16 bp, Artificial Sequence
  Synthetic oligonucleotide
ccaagagtttctctgc

SEQ ID NO: 132 - DNA, 14 bp, Artificial Sequence
  Synthetic oligonucleotide
caagagtttctctg

SEQ ID NO: 133 - DNA, 16 bp, Artificial Sequence
  Synthetic oligonucleotide
aattcacaccaggtcc

SEQ ID NO: 134 - DNA, 14 bp, Artificial Sequence
  Synthetic oligonucleotide
attcacaccaggtc

SEQ ID NO: 135 - DNA, 16 bp, Artificial Sequence
  Synthetic oligonucleotide
tgatctgacaccctga

SEQ ID NO: 136 - DNA, 14 bp, Artificial Sequence
  Synthetic oligonucleotide
gatctgacaccctg

SEQ ID NO: 137 - DNA, 16 bp, Artificial Sequence
  Synthetic oligonucleotide
agcccatgtgatctga

SEQ ID NO: 138 - DNA, 14 bp, Artificial Sequence
  Synthetic oligonucleotide
gcccatgtgatctg

SEQ ID NO: 139 - DNA, 16 bp, Artificial Sequence
  Synthetic oligonucleotide
ccatgttttctttgca

SEQ ID NO: 140 - DNA, 14 bp, Artificial Sequence
  Synthetic oligonucleotide
catgttttctttgc

SEQ ID NO: 141 - DNA, 16 bp, Artificial Sequence
  Synthetic oligonucleotide
cttgccagccatgttt

SEQ ID NO: 142 - DNA, 14 bp, Artificial Sequence
  Synthetic oligonucleotide
ttgccagccatgtt

SEQ ID NO: 143 - DNA, 20 bp, Artificial Sequence
  Synthetic oligonucleotide
gaagcccttgccagccatgt

SEQ ID NO: 144 - DNA, 16 bp, Artificial Sequence
  Synthetic oligonucleotide
aagcccttgccagcca

SEQ ID NO: 145 - DNA, 14 bp, Artificial Sequence
  Synthetic oligonucleotide
agcccttgccagcc

SEQ ID NO: 146 - DNA, 20 bp, Artificial Sequence
  Synthetic oligonucleotide
aaggagaagcccttgccagc

SEQ ID NO: 147 - DNA, 16 bp, Artificial Sequence
  Synthetic oligonucleotide
agaagcccttgccagc

SEQ ID NO: 148 - DNA, 16 bp, Artificial Sequence
  Synthetic oligonucleotide
gagaagcccttgccag

SEQ ID NO: 149 - DNA, 14 bp, Artificial Sequence
  Synthetic oligonucleotide
gaagcccttgccag

SEQ ID NO: 150 - DNA, 16 bp, Artificial Sequence
  Synthetic oligonucleotide
ggagaagcccttgcca

SEQ ID NO: 151 - DNA, 14 bp, Artificial Sequence
  Synthetic oligonucleotide
agaagcccttgcca

SEQ ID NO: 152 - DNA, 14 bp, Artificial Sequence
  Synthetic oligonucleotide
gagaagcccttgcc

SEQ ID NO: 153 - DNA, 16 bp, Artificial Sequence
  Synthetic oligonucleotide
actttttcacaaggtc

SEQ ID NO: 154 - DNA, 14 bp, Artificial Sequence
  Synthetic oligonucleotide
ctttttcacaaggt

SEQ ID NO: 155 - DNA, 16 bp, Artificial Sequence
  Synthetic oligonucleotide
ctcaagatggcccgct

SEQ ID NO: 156 - DNA, 14 bp, Artificial Sequence
  Synthetic oligonucleotide
tcaagatggcccgc

SEQ ID NO: 157 - DNA, 16 bp, Artificial Sequence
  Synthetic oligonucleotide
cctggaggcttagtgc

SEQ ID NO: 158 - DNA, 14 bp, Artificial Sequence
  Synthetic oligonucleotide
ctggaggcttagtg

SEQ ID NO: 159 - DNA, 16 bp, Artificial Sequence
  Synthetic oligonucleotide
ctccttctttgctgct

SEQ ID NO: 160 - DNA, 14 bp, Artificial Sequence
  Synthetic oligonucleotide
tccttctttgctgc

SEQ ID NO: 161 - DNA, 16 bp, Artificial Sequence
  Synthetic oligonucleotide
caagtgaaagtgacgc

SEQ ID NO: 162 - DNA, 14 bp, Artificial Sequence
  Synthetic oligonucleotide
aagtgaaagtgacg

SEQ ID NO: 163 - DNA, 16 bp, Artificial Sequence
  Synthetic oligonucleotide
accgctgatgtccttc

SEQ ID NO: 164 - DNA, 14 bp, Artificial Sequence
  Synthetic oligonucleotide
ccgctgatgtcctt

SEQ ID NO: 165 - DNA, 16 bp, Artificial Sequence
  Synthetic oligonucleotide
actggatctgggtctt

SEQ ID NO: 166 - DNA, 14 bp, Artificial Sequence
  Synthetic oligonucleotide
ctggatctgggtct

SEQ ID NO: 167 - DNA, 16 bp, Artificial Sequence
  Synthetic oligonucleotide
gctgctttgtgtatgg

SEQ ID NO: 168 - DNA, 14 bp, Artificial Sequence
  Synthetic oligonucleotide
ctgctttgtgtatg

SEQ ID NO: 169 - DNA, 16 bp, Artificial Sequence
  Synthetic oligonucleotide
tgttcagctgctgctt

SEQ ID NO: 170 - DNA, 14 bp, Artificial Sequence
  Synthetic oligonucleotide
gttcagctgctgct

SEQ ID NO: 171 - DNA, 16 bp, Artificial Sequence
  Synthetic oligonucleotide
tgacatgttgttcagc

SEQ ID NO: 172 - DNA, 14 bp, Artificial Sequence
  Synthetic oligonucleotide
gacatgttgttcag

SEQ ID NO: 173 - DNA, 16 bp, Artificial Sequence
  Synthetic oligonucleotide
catgatgatttcagca

SEQ ID NO: 174 - DNA, 14 bp, Artificial Sequence
  Synthetic oligonucleotide
atgatgatttcagc

SEQ ID NO: 175 - DNA, 16 bp, Artificial Sequence
  Synthetic oligonucleotide
ccatgatcttatagcc

SEQ ID NO: 176 - DNA, 14 bp, Artificial Sequence
  Synthetic oligonucleotide
catgatcttatagc

SEQ ID NO: 177 - DNA, 16 bp, Artificial Sequence
  Synthetic oligonucleotide
gtggagacaccaggat

SEQ ID NO: 178 - DNA, 14 bp, Artificial Sequence
  Synthetic oligonucleotide
tggagacaccagga

SEQ ID NO: 179 - DNA, 16 bp, Artificial Sequence
  Synthetic oligonucleotide
aatgtcaggatagaga

SEQ ID NO: 180 - DNA, 14 bp, Artificial Sequence
  Synthetic oligonucleotide
atgtcaggatagag

SEQ ID NO: 181 - DNA, 16 bp, Artificial Sequence
  Synthetic oligonucleotide
cctccttgggaatgtc

SEQ ID NO: 182 - DNA, 20 bp, Artificial Sequence
  Synthetic oligonucleotide
tgcctcctccttgggaatgt

SEQ ID NO: 183 - DNA, 14 bp, Artificial Sequence
  Synthetic oligonucleotide
ctccttgggaatgt

SEQ ID NO: 184 - DNA, 16 bp, Artificial Sequence
  Synthetic oligonucleotide
cctcctccttgggaat

SEQ ID NO: 185 - DNA, 14 bp, Artificial Sequence
  Synthetic oligonucleotide
ctcctccttgggaa

SEQ ID NO: 186 - DNA, 16 bp, Artificial Sequence
  Synthetic oligonucleotide
cgaatgcctcctcctt

SEQ ID NO: 187 - DNA, 14 bp, Artificial Sequence
  Synthetic oligonucleotide
gaatgcctcctcct

SEQ ID NO: 188 - DNA, 16 bp, Artificial Sequence
  Synthetic oligonucleotide
tctctggccgacaata

SEQ ID NO: 189 - DNA, 14 bp, Artificial Sequence
  Synthetic oligonucleotide
ctctggccgacaat

SEQ ID NO: 190 - DNA, 16 bp, Artificial Sequence
  Synthetic oligonucleotide
acttggtcttcaggta

SEQ ID NO: 191 - DNA, 14 bp, Artificial Sequence
  Synthetic oligonucleotide
cttggtcttcaggt

SEQ ID NO: 192 - DNA, 16 bp, Artificial Sequence
  Synthetic oligonucleotide
ttggtgtcacacagat

SEQ ID NO: 193 - DNA, 14 bp, Artificial Sequence
  Synthetic oligonucleotide
tggtgtcacacaga

SEQ ID NO: 194 - DNA, 16 bp, Artificial Sequence
  Synthetic oligonucleotide
gtattgctgcaggtcg

SEQ ID NO: 195 - DNA, 14 bp, Artificial Sequence
  Synthetic oligonucleotide
tattgctgcaggtc

SEQ ID NO: 196 - DNA, 16 bp, Artificial Sequence
  Synthetic oligonucleotide
ggtcaatggtattgct

SEQ ID NO: 197 - DNA, 14 bp, Artificial Sequence
  Synthetic oligonucleotide
gtcaatggtattgc

SEQ ID NO: 198 - DNA, 16 bp, Artificial Sequence
  Synthetic oligonucleotide
catcggcaggtcaatg

SEQ ID NO: 199 - DNA, 14 bp, Artificial Sequence
  Synthetic oligonucleotide
atcggcaggtcaat

SEQ ID NO: 200 - DNA, 16 bp, Artificial Sequence
  Synthetic oligonucleotide
gaatctaaagtgcggg

SEQ ID NO: 201 - DNA, 14 bp, Artificial Sequence
  Synthetic oligonucleotide
aatctaaagtgcgg

SEQ ID NO: 202 - DNA, 16 bp, Artificial Sequence
  Synthetic oligonucleotide
gcatcaatgaatctaa

SEQ ID NO: 203 - DNA, 14 bp, Artificial Sequence
  Synthetic oligonucleotide
catcaatgaatcta

SEQ ID NO: 204 - DNA, 16 bp, Artificial Sequence
  Synthetic oligonucleotide
tccaaactgcatcaat

SEQ ID NO: 205 - DNA, 14 bp, Artificial Sequence
  Synthetic oligonucleotide
ccaaactgcatcaa

SEQ ID NO: 206 - DNA, 16 bp, Artificial Sequence
  Synthetic oligonucleotide
ttcagcaccttcacca

SEQ ID NO: 207 - DNA, 14 bp, Artificial Sequence
  Synthetic oligonucleotide
tcagcaccttcacc

SEQ ID NO: 208 - DNA, 16 bp, Artificial Sequence
  Synthetic oligonucleotide
gccctcctgctgaggg

SEQ ID NO: 209 - DNA, 14 bp, Artificial Sequence
  Synthetic oligonucleotide
ccctcctgctgagg

SEQ ID NO: 210 - DNA, 16 bp, Artificial Sequence
  Synthetic oligonucleotide
ctcaaactgccctcct

SEQ ID NO: 211 - DNA, 14 bp, Artificial Sequence
  Synthetic oligonucleotide
caaactgccctcct

SEQ ID NO: 212 - DNA, 14 bp, Artificial Sequence
  Synthetic oligonucleotide
tcaaactgccctcc

SEQ ID NO: 213 - DNA, 16 bp, Artificial Sequence
  Synthetic oligonucleotide
ccatgtcaaaggtgag

SEQ ID NO: 214 - DNA, 14 bp, Artificial Sequence
  Synthetic oligonucleotide
catgtcaaaggtga

SEQ ID NO: 215 - DNA, 16 bp, Artificial Sequence
  Synthetic oligonucleotide
gggaggtagcgcactc

SEQ ID NO: 216 - DNA, 14 bp, Artificial Sequence
  Synthetic oligonucleotide
ggaggtagcgcact

SEQ ID NO: 217 - DNA, 16 bp, Artificial Sequence
  Synthetic oligonucleotide
gaatgcaggtaggcgc

SEQ ID NO: 218 - DNA, 14 bp, Artificial Sequence
  Synthetic oligonucleotide
aatgcaggtaggcg

SEQ ID NO: 219 - DNA, 16 bp, Artificial Sequence
  Synthetic oligonucleotide
tttcagatgatctggg

SEQ ID NO: 220 - DNA, 14 bp, Artificial Sequence
  Synthetic oligonucleotide
ttcagatgatctgg

SEQ ID NO: 221 - DNA, 16 bp, Artificial Sequence
  Synthetic oligonucleotide
ggaaccacaaagttag

SEQ ID NO: 222 - DNA, 14 bp, Artificial Sequence
  Synthetic oligonucleotide
gaaccacaaagtta

SEQ ID NO: 223 - DNA, 16 bp, Artificial Sequence
  Synthetic oligonucleotide
gatagcagaagtagga

SEQ ID NO: 224 - DNA, 14 bp, Artificial Sequence
  Synthetic oligonucleotide
atagcagaagtagg

SEQ ID NO: 225 - DNA, 16 bp, Artificial Sequence
  Synthetic oligonucleotide
aaagtgcccagattgc

SEQ ID NO: 226 - DNA, 14 bp, Artificial Sequence
  Synthetic oligonucleotide
aagtgcccagattg

SEQ ID NO: 227 - DNA, 16 bp, Artificial Sequence
  Synthetic oligonucleotide
cactcatttctctatt

SEQ ID NO: 228 - DNA, 14 bp, Artificial Sequence
  Synthetic oligonucleotide
actcatttctctat

SEQ ID NO: 229 - DNA, 16 bp, Artificial Sequence
  Synthetic oligonucleotide
aacacatccttatttg

SEQ ID NO: 230 - DNA, 14 bp, Artificial Sequence
  Synthetic oligonucleotide
acacatccttattt

SEQ ID NO: 231 - DNA, 16 bp, Artificial Sequence
  Synthetic oligonucleotide
tgggtctcagagaaca

SEQ ID NO: 232 - DNA, 14 bp, Artificial Sequence
  Synthetic oligonucleotide
gggtctcagagaac

SEQ ID NO: 233 - DNA, 16 bp, Artificial Sequence
  Synthetic oligonucleotide
caagacatttcctttt

SEQ ID NO: 234 - DNA, 14 bp, Artificial Sequence
  Synthetic oligonucleotide
aagacatttccttt

SEQ ID NO: 235 - DNA, 16 bp, Artificial Sequence
  Synthetic oligonucleotide
ggaggcacttgtctaa

SEQ ID NO: 236 - DNA, 14 bp, Artificial Sequence
  Synthetic oligonucleotide
gaggcacttgtcta

SEQ ID NO: 237 - DNA, 16 bp, Artificial Sequence
  Synthetic oligonucleotide
ttacagaaacaggcag

SEQ ID NO: 238 - DNA, 14 bp, Artificial Sequence
  Synthetic oligonucleotide
tacagaaacaggca

SEQ ID NO: 239 - DNA, 16 bp, Artificial Sequence
  Synthetic oligonucleotide
agctataggtggcctg

SEQ ID NO: 240 - DNA, 14 bp, Artificial Sequence
  Synthetic oligonucleotide
gctataggtggcct

SEQ ID NO: 241 - DNA, 16 bp, Artificial Sequence
  Synthetic oligonucleotide
atgccaggagtatgta

SEQ ID NO: 242 - DNA, 14 bp, Artificial Sequence
  Synthetic oligonucleotide
tgccaggagtatgt

SEQ ID NO: 243 - DNA, 16 bp, Artificial Sequence
  Synthetic oligonucleotide
caaggttaaaaagtgc

SEQ ID NO: 244 - DNA, 14 bp, Artificial Sequence
  Synthetic oligonucleotide
aaggttaaaaagtg

SEQ ID NO: 245 - DNA, 16 bp, Artificial Sequence
  Synthetic oligonucleotide
ctatttggatgtcagc

SEQ ID NO: 246 - DNA, 14 bp, Artificial Sequence
  Synthetic oligonucleotide
tatttggatgtcag

SEQ ID NO: 247 - DNA, 16 bp, Artificial Sequence
  Synthetic oligonucleotide
tagatagtcctatctt

SEQ ID NO: 248 - DNA, 14 bp, Artificial Sequence
  Synthetic oligonucleotide
agatagtcctatct

SEQ ID NO: 249 - DNA, 16 bp, Artificial Sequence
  Synthetic oligonucleotide
aagaaacctagggctt

SEQ ID NO: 250 - DNA, 14 bp, Artificial Sequence
  Synthetic oligonucleotide
agaaacctagggct

SEQ ID NO: 251 - DNA, 16 bp, Artificial Sequence
  Synthetic oligonucleotide
gctgatacagtgtttt

SEQ ID NO: 252 - DNA, 14 bp, Artificial Sequence
  Synthetic oligonucleotide
ctgatacagtgttt

SEQ ID NO: 253 - DNA, 16 bp, Artificial Sequence
  Synthetic oligonucleotide
atacagaaaggctatg

SEQ ID NO: 254 - DNA, 14 bp, Artificial Sequence
  Synthetic oligonucleotide
tacagaaaggctat

SEQ ID NO: 255 - DNA, 16 bp, Artificial Sequence
  Synthetic oligonucleotide
gcttaagtttcttaaa

SEQ ID NO: 256 - DNA, 14 bp, Artificial Sequence
  Synthetic oligonucleotide
cttaagtttcttaa

SEQ ID NO: 257 - DNA, 16 bp, Artificial Sequence
  Synthetic oligonucleotide
agcaccaaggaggctg

SEQ ID NO: 258 - DNA, 14 bp, Artificial Sequence
  Synthetic oligonucleotide
gcaccaaggaggct

SEQ ID NO: 259 - DNA, 16 bp, Artificial Sequence
  Synthetic oligonucleotide
aagctgaatgcttaaa

SEQ ID NO: 260 - DNA, 14 bp, Artificial Sequence
  Synthetic oligonucleotide
agctgaatgcttaa

SEQ ID NO: 261 - DNA, 16 bp, Artificial Sequence
  Synthetic oligonucleotide
ttaccagcctgaagga

SEQ ID NO: 262 - DNA, 14 bp, Artificial Sequence
  Synthetic oligonucleotide
taccagcctgaagg

SEQ ID NO: 263 - DNA, 16 bp, Artificial Sequence
  Synthetic oligonucleotide
cagggattatataaat

SEQ ID NO: 264 - DNA, 14 bp, Artificial Sequence
  Synthetic oligonucleotide
agggattatataaa

SEQ ID NO: 265 - DNA, 16 bp, Artificial Sequence
  Synthetic oligonucleotide
acctgaagcccgtttc

SEQ ID NO: 266 - DNA, 14 bp, Artificial Sequence
  Synthetic oligonucleotide
cctgaagcccgttt

SEQ ID NO: 267 - DNA, 16 bp, Artificial Sequence
  Synthetic oligonucleotide
tgtcttaagggtttga

SEQ ID NO: 268 - DNA, 14 bp, Artificial Sequence
  Synthetic oligonucleotide
gtcttaagggtttg

SEQ ID NO: 269 - DNA, 16 bp, Artificial Sequence
  Synthetic oligonucleotide
ggttgcagcttcagat

SEQ ID NO: 270 - DNA, 14 bp, Artificial Sequence
  Synthetic oligonucleotide
gttgcagcttcaga

SEQ ID NO: 271 - DNA, 16 bp, Artificial Sequence
  Synthetic oligonucleotide
tcaacaccaaaggcca

SEQ ID NO: 272 - DNA, 14 bp, Artificial Sequence
  Synthetic oligonucleotide
caacaccaaaggcc

SEQ ID NO: 273 - DNA, 16 bp, Artificial Sequence
  Synthetic oligonucleotide
tccttaaaccttccta

SEQ ID NO: 274 - DNA, 14 bp, Artificial Sequence
  Synthetic oligonucleotide
ccttaaaccttcct

SEQ ID NO: 275 - DNA, 16 bp, Artificial Sequence
  Synthetic oligonucleotide
aaaatgcttagattct

SEQ ID NO: 276 - DNA, 14 bp, Artificial Sequence
  Synthetic oligonucleotide
aaatgcttagattc

SEQ ID NO: 277 - DNA, 16 bp, Artificial Sequence
  Synthetic oligonucleotide
aaataagtctatttat

SEQ ID NO: 278 - DNA, 14 bp, Artificial Sequence
  Synthetic oligonucleotide
aataagtctattta

SEQ ID NO: 279 - DNA, 16 bp, Artificial Sequence
  Synthetic oligonucleotide
ggccaatacattacaa

SEQ ID NO: 280 - DNA, 14 bp, Artificial Sequence
  Synthetic oligonucleotide
gccaatacattaca

SEQ ID NO: 281 - DNA, 16 bp, Artificial Sequence
  Synthetic oligonucleotide
tgcccagccttactca

SEQ ID NO: 282 - DNA, 14 bp, Artificial Sequence
  Synthetic oligonucleotide
gcccagccttactc

SEQ ID NO: 283 - DNA, 16 bp, Artificial Sequence
  Synthetic oligonucleotide
gttgtaagcaccctct

SEQ ID NO: 284 - DNA, 14 bp, Artificial Sequence
  Synthetic oligonucleotide
ttgtaagcaccctc

SEQ ID NO: 285 - DNA, 16 bp, Artificial Sequence
  Synthetic oligonucleotide
agaaagggagtcaagg

SEQ ID NO: 286 - DNA, 14 bp, Artificial Sequence
  Synthetic oligonucleotide
gaaagggagtcaag

SEQ ID NO: 287 - DNA, 16 bp, Artificial Sequence
  Synthetic oligonucleotide
gcagatcaagtccagg

SEQ ID NO: 288 - DNA, 14 bp, Artificial Sequence
  Synthetic oligonucleotide
cagatcaagtccag

SEQ ID NO: 289 - DNA, 16 bp, Artificial Sequence
  Synthetic oligonucleotide
agcctctgaaacagca

SEQ ID NO: 290 - DNA, 14 bp, Artificial Sequence
  Synthetic oligonucleotide
gcctctgaaacagc

SEQ ID NO: 291 - DNA, 16 bp, Artificial Sequence
  Synthetic oligonucleotide
cccacagaaacaacct

SEQ ID NO: 292 - DNA, 14 bp, Artificial Sequence
  Synthetic oligonucleotide
ccacagaaacaacc

SEQ ID NO: 293 - DNA, 16 bp, Artificial Sequence
  Synthetic oligonucleotide
agccctgataaggcac

SEQ ID NO: 294 - DNA, 14 bp, Artificial Sequence
  Synthetic oligonucleotide
gccctgataaggca

SEQ ID NO: 295 - DNA, 16 bp, Artificial Sequence
  Synthetic oligonucleotide
aatcagaagtatccca

SEQ ID NO: 296 - DNA, 14 bp, Artificial Sequence
  Synthetic oligonucleotide
atcagaagtatccc

SEQ ID NO: 297 - DNA, 16 bp, Artificial Sequence
  Synthetic oligonucleotide
gcctctagcaggatca

SEQ ID NO: 298 - DNA, 14 bp, Artificial Sequence
  Synthetic oligonucleotide
cctctagcaggatc

SEQ ID NO: 299 - DNA, 16 bp, Artificial Sequence
  Synthetic oligonucleotide
cacgcaaggagacatg

SEQ ID NO: 300 - DNA, 14 bp, Artificial Sequence
  Synthetic oligonucleotide
acgcaaggagacat

SEQ ID NO: 301 - DNA, 16 bp, Artificial Sequence
  Synthetic oligonucleotide
tgagggacctttagac

SEQ ID NO: 302 - DNA, 14 bp, Artificial Sequence
  Synthetic oligonucleotide
gagggacctttaga

SEQ ID NO: 303 - DNA, 16 bp, Artificial Sequence
  Synthetic oligonucleotide
caggattcctaaaaca

SEQ ID NO: 304 - DNA, 14 bp, Artificial Sequence
  Synthetic oligonucleotide
aggattcctaaaac

SEQ ID NO: 305 - DNA, 16 bp, Artificial Sequence
  Synthetic oligonucleotide
atgaggtcctgagacc

SEQ ID NO: 306 - DNA, 14 bp, Artificial Sequence
  Synthetic oligonucleotide
tgaggtcctgagac

SEQ ID NO: 307 - DNA, 16 bp, Artificial Sequence
  Synthetic oligonucleotide
catcatgtccaacctg

SEQ ID NO: 308 - DNA, 14 bp, Artificial Sequence
  Synthetic oligonucleotide
atcatgtccaacct

SEQ ID NO: 309 - DNA, 16 bp, Artificial Sequence
  Synthetic oligonucleotide
gggccccatagtgtgc

SEQ ID NO: 310 - DNA, 14 bp, Artificial Sequence
  Synthetic oligonucleotide
ggccccatagtgtg

SEQ ID NO: 311 - DNA, 16 bp, Artificial Sequence
  Synthetic oligonucleotide
agctcaaccagacacg

SEQ ID NO: 312 - DNA, 14 bp, Artificial Sequence
  Synthetic oligonucleotide
gctcaaccagacac

SEQ ID NO: 313 - DNA, 16 bp, Artificial Sequence
  Synthetic oligonucleotide
gaaccatattccctga

SEQ ID NO: 314 - DNA, 14 bp, Artificial Sequence
  Synthetic oligonucleotide
aaccatattccctg

SEQ ID NO: 315 - DNA, 16 bp, Artificial Sequence
  Synthetic oligonucleotide
caagaaactggctaag

SEQ ID NO: 316 - DNA, 14 bp, Artificial Sequence
  Synthetic oligonucleotide
aagaaactggctaa

SEQ ID NO: 317 - DNA, 16 bp, Artificial Sequence
  Synthetic oligonucleotide
gccactggatatcacc

SEQ ID NO: 318 - DNA, 16 bp, Artificial Sequence
  Synthetic oligonucleotide
aactgaatgaagacgc

SEQ ID NO: 319 - DNA, 14 bp, Artificial Sequence
  Synthetic oligonucleotide
actgaatgaagacg

SEQ ID NO: 320 - DNA, 16 bp, Artificial Sequence
  Synthetic oligonucleotide
cctttgccctgcatga

SEQ ID NO: 321 - DNA, 14 bp, Artificial Sequence
  Synthetic oligonucleotide
ctttgccctgcatg

SEQ ID NO: 322 - DNA, 16 bp, Artificial Sequence
  Synthetic oligonucleotide
aagtttatcagtaagc

SEQ ID NO: 323 - DNA, 14 bp, Artificial Sequence
  Synthetic oligonucleotide
agtttatcagtaag

SEQ ID NO: 324 - DNA, 16 bp, Artificial Sequence
  Synthetic oligonucleotide
tacgagggcagactca

SEQ ID NO: 325 - DNA, 14 bp, Artificial Sequence
  Synthetic oligonucleotide
acgagggcagactc

SEQ ID NO: 326 - DNA, 16 bp, Artificial Sequence
  Synthetic oligonucleotide
aggtatacaccctcat

SEQ ID NO: 327 - DNA, 14 bp, Artificial Sequence
  Synthetic oligonucleotide
ggtatacaccctca

SEQ ID NO: 328 - DNA, 16 bp, Artificial Sequence
  Synthetic oligonucleotide
cctcagagggaggcca

SEQ ID NO: 329 - DNA, 14 bp, Artificial Sequence
  Synthetic oligonucleotide
ctcagagggaggcc

SEQ ID NO: 330 - DNA, 16 bp, Artificial Sequence
  Synthetic oligonucleotide
gggaggagtcaccagc

SEQ ID NO: 331 - DNA, 14 bp, Artificial Sequence
  Synthetic oligonucleotide
ggaggagtcaccag

SEQ ID NO: 332 - DNA, 16 bp, Artificial Sequence
  Synthetic oligonucleotide
tagccagccaaggcgg

SEQ ID NO: 333 - DNA, 14 bp, Artificial Sequence
  Synthetic oligonucleotide
agccagccaaggcg

SEQ ID NO: 334 - DNA, 16 bp, Artificial Sequence
  Synthetic oligonucleotide
acaggagaggcgagct

SEQ ID NO: 335 - DNA, 14 bp, Artificial Sequence
  Synthetic oligonucleotide
caggagaggcgagc

SEQ ID NO: 336 - DNA, 16 bp, Artificial Sequence
  Synthetic oligonucleotide
taggtgttcccatacg

SEQ ID NO: 337 - DNA, 14 bp, Artificial Sequence
  Synthetic oligonucleotide
aggtgttcccatac

SEQ ID NO: 338 - DNA, 16 bp, Artificial Sequence
  Synthetic oligonucleotide
ggcagcccatccagca

SEQ ID NO: 339 - DNA, 14 bp, Artificial Sequence
  Synthetic oligonucleotide
gcagcccatccagc

SEQ ID NO: 340 - DNA, 16 bp, Artificial Sequence
  Synthetic oligonucleotide
catgcctctgagtcag

SEQ ID NO: 341 - DNA, 14 bp, Artificial Sequence
  Synthetic oligonucleotide
atgcctctgagtca

SEQ ID NO: 342 - DNA, 16 bp, Artificial Sequence
  Synthetic oligonucleotide
gttgccaaatccggcc

SEQ ID NO: 343 - DNA, 14 bp, Artificial Sequence
  Synthetic oligonucleotide
ttgccaaatccggc

SEQ ID NO: 344 - DNA, 16 bp, Artificial Sequence
  Synthetic oligonucleotide
gcaaggtggttttgag

SEQ ID NO: 345 - DNA, 14 bp, Artificial Sequence
  Synthetic oligonucleotide
caaggtggttttga

SEQ ID NO: 346 - DNA, 16 bp, Artificial Sequence
  Synthetic oligonucleotide
agaaactctgatcagc

SEQ ID NO: 347 - DNA, 14 bp, Artificial Sequence
  Synthetic oligonucleotide
gaaactctgatcag

SEQ ID NO: 348 - DNA, 16 bp, Artificial Sequence
  Synthetic oligonucleotide
cagagaccagctaatt

SEQ ID NO: 349 - DNA, 14 bp, Artificial Sequence
  Synthetic oligonucleotide
agagaccagctaat

SEQ ID NO: 350 - DNA, 16 bp, Artificial Sequence
  Synthetic oligonucleotide
atcttagagaaggtcg

SEQ ID NO: 351 - DNA, 14 bp, Artificial Sequence
  Synthetic oligonucleotide
tcttagagaaggtc

SEQ ID NO: 352 - DNA, 16 bp, Artificial Sequence
  Synthetic oligonucleotide
ccaggcaggaggactg

SEQ ID NO: 353 - DNA, 14 bp, Artificial Sequence
  Synthetic oligonucleotide
caggcaggaggact

SEQ ID NO: 354 - DNA, 16 bp, Artificial Sequence
  Synthetic oligonucleotide
catcaactgtctccag

SEQ ID NO: 355 - DNA, 14 bp, Artificial Sequence
  Synthetic oligonucleotide
atcaactgtctcca

SEQ ID NO: 356 - DNA, 16 bp, Artificial Sequence
  Synthetic oligonucleotide
cacatcaactgtctcc

SEQ ID NO: 357 - DNA, 14 bp, Artificial Sequence
  Synthetic oligonucleotide
acatcaactgtctc

SEQ ID NO: 358 - DNA, 16 bp, Artificial Sequence
  Synthetic oligonucleotide
gaagtaagagctctgc

SEQ ID NO: 359 - DNA, 14 bp, Artificial Sequence
  Synthetic oligonucleotide
aagtaagagctctg

SEQ ID NO: 360 - DNA, 16 bp, Artificial Sequence
  Synthetic oligonucleotide
aagagtgttgctggag

SEQ ID NO: 361 - DNA, 14 bp, Artificial Sequence
  Synthetic oligonucleotide
agagtgttgctgga

SEQ ID NO: 362 - DNA, 16 bp, Artificial Sequence
  Synthetic oligonucleotide
gcttattatgtactga

SEQ ID NO: 363 - DNA, 14 bp, Artificial Sequence
  Synthetic oligonucleotide
cttattatgtactg

SEQ ID NO: 364 - DNA, 16 bp, Artificial Sequence
  Synthetic oligonucleotide
gcccaagtctcacctt

SEQ ID NO: 365 - DNA, 14 bp, Artificial Sequence
  Synthetic oligonucleotide
cccaagtctcacct

SEQ ID NO: 366 - DNA, 16 bp, Artificial Sequence
  Synthetic oligonucleotide
cccaatggtaagccca

SEQ ID NO: 367 - DNA, 14 bp, Artificial Sequence
  Synthetic oligonucleotide
ccaatggtaagccc

SEQ ID NO: 368 - DNA, 16 bp, Artificial Sequence
  Synthetic oligonucleotide
aacccaatggtaagcc

SEQ ID NO: 369 - DNA, 14 bp, Artificial Sequence
  Synthetic oligonucleotide
acccaatggtaagc

SEQ ID NO: 370 - DNA, 16 bp, Artificial Sequence
  Synthetic oligonucleotide
taggtccctatgattt

SEQ ID NO: 371 - DNA, 14 bp, Artificial Sequence
  Synthetic oligonucleotide
aggtccctatgatt

SEQ ID NO: 372 - DNA, 16 bp, Artificial Sequence
  Synthetic oligonucleotide
aagccctgaaccctcg

SEQ ID NO: 373 - DNA, 14 bp, Artificial Sequence
  Synthetic oligonucleotide
agccctgaaccctc

SEQ ID NO: 374 - DNA, 16 bp, Artificial Sequence
  Synthetic oligonucleotide
cctaaggccatgaact

SEQ ID NO: 375 - DNA, 14 bp, Artificial Sequence
  Synthetic oligonucleotide
ctaaggccatgaac

SEQ ID NO: 376 - DNA, 16 bp, Artificial Sequence
  Synthetic oligonucleotide
accagatacatgctac

SEQ ID NO: 377 - DNA, 14 bp, Artificial Sequence
  Synthetic oligonucleotide
ccagatacatgcta

SEQ ID NO: 378 - DNA, 16 bp, Artificial Sequence
  Synthetic oligonucleotide
tacaatcagagttaag

SEQ ID NO: 379 - DNA, 14 bp, Artificial Sequence
  Synthetic oligonucleotide
acaatcagagttaa

SEQ ID NO: 380 - DNA, 16 bp, Artificial Sequence
  Synthetic oligonucleotide
tcctctcagaactttt

SEQ ID NO: 381 - DNA, 14 bp, Artificial Sequence
  Synthetic oligonucleotide
cctctcagaacttt

SEQ ID NO: 382 - DNA, 16 bp, Artificial Sequence
  Synthetic oligonucleotide
gctcctctcagaactt

SEQ ID NO: 383 - DNA, 14 bp, Artificial Sequence
  Synthetic oligonucleotide
ctcctctcagaact

SEQ ID NO: 384 - DNA, 16 bp, Artificial Sequence
  Synthetic oligonucleotide
ttctttaatgggccac

SEQ ID NO: 385 - DNA, 14 bp, Artificial Sequence
  Synthetic oligonucleotide
tctttaatgggcca

SEQ ID NO: 386 - DNA, 16 bp, Artificial Sequence
  Synthetic oligonucleotide
acgggattccctcggc

SEQ ID NO: 387 - DNA, 14 bp, Artificial Sequence
  Synthetic oligonucleotide
cgggattccctcgg

SEQ ID NO: 388 - DNA, 16 bp, Artificial Sequence
  Synthetic oligonucleotide
gtaggtaagcaaccca

SEQ ID NO: 389 - DNA, 14 bp, Artificial Sequence
  Synthetic oligonucleotide
taggtaagcaaccc

SEQ ID NO: 390 - DNA, 16 bp, Artificial Sequence
  Synthetic oligonucleotide
gaatttgaatgcagtg

SEQ ID NO: 391 - DNA, 14 bp, Artificial Sequence
  Synthetic oligonucleotide
aatttgaatgcagt

SEQ ID NO: 392 - DNA, 16 bp, Artificial Sequence
  Synthetic oligonucleotide
tgaagtacacattgga

SEQ ID NO: 393 - DNA, 14 bp, Artificial Sequence
  Synthetic oligonucleotide
gaagtacacattgg

SEQ ID NO: 394 - DNA, 16 bp, Artificial Sequence
  Synthetic oligonucleotide
ataaatttttacacta

SEQ ID NO: 395 - DNA, 14 bp, Artificial Sequence
  Synthetic oligonucleotide
taaatttttacact

SEQ ID NO: 396 - DNA, 14 bp, Artificial Sequence
  Synthetic oligonucleotide
caataatataaatt

SEQ ID NO: 397 - DNA, 16 bp, Artificial Sequence
  Synthetic oligonucleotide
ctggaagttaaagtag

SEQ ID NO: 398 - DNA, 14 bp, Artificial Sequence
  Synthetic oligonucleotide
tggaagttaaagta

SEQ ID NO: 399 - DNA, 16 bp, Artificial Sequence
  Synthetic oligonucleotide
ggctcaattatttatc

SEQ ID NO: 400 - DNA, 14 bp, Artificial Sequence
  Synthetic oligonucleotide
gctcaattatttat

SEQ ID NO: 401 - DNA, 16 bp, Artificial Sequence
  Synthetic oligonucleotide
aatgcaatggctcaat

SEQ ID NO: 402 - DNA, 14 bp, Artificial Sequence
  Synthetic oligonucleotide
atgcaatggctcaa

SEQ ID NO: 403 - DNA, 16 bp, Artificial Sequence
  Synthetic oligonucleotide
atccagtaaatgcaat

SEQ ID NO: 404 - DNA, 14 bp, Artificial Sequence
  Synthetic oligonucleotide
tccagtaaatgcaa

SEQ ID NO: 405 - DNA, 16 bp, Artificial Sequence
  Synthetic oligonucleotide
agaaaactcccactct

SEQ ID NO: 406 - DNA, 14 bp, Artificial Sequence
  Synthetic oligonucleotide
gaaaactcccactc

SEQ ID NO: 407 - DNA, 16 bp, Artificial Sequence
  Synthetic oligonucleotide
ctgtctttgtttccct

SEQ ID NO: 408 - DNA, 14 bp, Artificial Sequence
  Synthetic oligonucleotide
tgtctttgtttccc

SEQ ID NO: 409 - DNA, 16 bp, Artificial Sequence
  Synthetic oligonucleotide
aggccagcctgtcttt

SEQ ID NO: 410 - DNA, 14 bp, Artificial Sequence
  Synthetic oligonucleotide
ggccagcctgtctt

SEQ ID NO: 411 - DNA, 16 bp, Artificial Sequence
  Synthetic oligonucleotide
ctaatggttctttgtg

SEQ ID NO: 412 - DNA, 14 bp, Artificial Sequence
  Synthetic oligonucleotide
taatggttctttgt

SEQ ID NO: 413 - DNA, 16 bp, Artificial Sequence
  Synthetic oligonucleotide
gaaattcattcttcca

SEQ ID NO: 414 - DNA, 14 bp, Artificial Sequence
  Synthetic oligonucleotide
aaattcattcttcc

SEQ ID NO: 415 - DNA, 16 bp, Artificial Sequence
  Synthetic oligonucleotide
acacacacagatgtga

SEQ ID NO: 416 - DNA, 14 bp, Artificial Sequence
  Synthetic oligonucleotide
cacacacagatgtg

SEQ ID NO: 417 - DNA, 16 bp, Artificial Sequence
  Synthetic oligonucleotide
ctacccaaacatcccc

SEQ ID NO: 418 - DNA, 14 bp, Artificial Sequence
  Synthetic oligonucleotide
tacccaaacatccc

SEQ ID NO: 419 - DNA, 16 bp, Artificial Sequence
  Synthetic oligonucleotide
tacaaaaactacccaa

SEQ ID NO: 420 - DNA, 14 bp, Artificial Sequence
  Synthetic oligonucleotide
acaaaaactaccca

SEQ ID NO: 421 - DNA, 16 bp, Artificial Sequence
  Synthetic oligonucleotide
agttttcagaaatggc

SEQ ID NO: 422 - DNA, 14 bp, Artificial Sequence
  Synthetic oligonucleotide
gttttcagaaatgg

SEQ ID NO: 423 - DNA, 16 bp, Artificial Sequence
  Synthetic oligonucleotide
caagcttttctatgaa

SEQ ID NO: 424 - DNA, 14 bp, Artificial Sequence
  Synthetic oligonucleotide
aagcttttctatga

SEQ ID NO: 425 - DNA, 16 bp, Artificial Sequence
  Synthetic oligonucleotide
ttattcaggtcacttt

SEQ ID NO: 426 - DNA, 14 bp, Artificial Sequence
  Synthetic oligonucleotide
tattcaggtcactt

SEQ ID NO: 427-429 - skipped (3 entries)

SEQ ID NO: 430 - DNA, 16 bp, Artificial Sequence
  Synthetic oligonucleotide
gcatatgccctaggaa

SEQ ID NO: 431 - DNA, 14 bp, Artificial Sequence
  Synthetic oligonucleotide
catatgccctagga

SEQ ID NO: 432 - DNA, 16 bp, Artificial Sequence
  Synthetic oligonucleotide
gctaattacttctcct

SEQ ID NO: 433 - DNA, 14 bp, Artificial Sequence
  Synthetic oligonucleotide
ctaattacttctcc

SEQ ID NO: 434 - DNA, 16 bp, Artificial Sequence
  Synthetic oligonucleotide
gcccccttgctgccaa

SEQ ID NO: 435 - DNA, 14 bp, Artificial Sequence
  Synthetic oligonucleotide
cccccttgctgcca

SEQ ID NO: 436 - DNA, 16 bp, Artificial Sequence
  Synthetic oligonucleotide
tgttctagatcctgtt

SEQ ID NO: 437 - DNA, 14 bp, Artificial Sequence
  Synthetic oligonucleotide
gttctagatcctgt

SEQ ID NO: 438 - DNA, 16 bp, Artificial Sequence
  Synthetic oligonucleotide
ctctccgcatctggtc

SEQ ID NO: 439 - DNA, 16 bp, Artificial Sequence
  Synthetic oligonucleotide
tgaccagcaacctatt

SEQ ID NO: 440 - DNA, 14 bp, Artificial Sequence
  Synthetic oligonucleotide
gaccagcaacctat

SEQ ID NO: 441 - DNA, 16 bp, Artificial Sequence
  Synthetic oligonucleotide
cccagagtctctgtaa

SEQ ID NO: 442 - DNA, 14 bp, Artificial Sequence
  Synthetic oligonucleotide
ccagagtctctgta

SEQ ID NO: 443-444 - skipped (2 entries)

SEQ ID NO: 445 - DNA, 16 bp, Artificial Sequence
  Synthetic oligonucleotide
ttacatcacaattggc

SEQ ID NO: 446 - DNA, 16 bp, Artificial Sequence
  Synthetic oligonucleotide
gcaaggagtgggtctg

SEQ ID NO: 447 - DNA, 16 bp, Artificial Sequence
  Synthetic oligonucleotide
tttcctggagaaaaga

SEQ ID NO: 448 - DNA, 14 bp, Artificial Sequence
  Synthetic oligonucleotide
ttcctggagaaaag

SEQ ID NO: 449 - DNA, 16 bp, Artificial Sequence
  Synthetic oligonucleotide
agccatgttttcctgg

SEQ ID NO: 450 - DNA, 14 bp, Artificial Sequence
  Synthetic oligonucleotide
gccatgttttcctg

SEQ ID NO: 451 - DNA, 16 bp, Artificial Sequence
  Synthetic oligonucleotide
aacaactacctgggtc

SEQ ID NO: 452 - DNA, 14 bp, Artificial Sequence
  Synthetic oligonucleotide
acaactacctgggt

SEQ ID NO: 453 - DNA, 16 bp, Artificial Sequence
  Synthetic oligonucleotide
acggtgtcacacagat

SEQ ID NO: 454 - DNA, 14 bp, Artificial Sequence
  Synthetic oligonucleotide
cggtgtcacacaga

SEQ ID NO: 455 - DNA, 16 bp, Artificial Sequence
  Synthetic oligonucleotide
aacacacaaggtcact

SEQ ID NO: 456 - DNA, 14 bp, Artificial Sequence
  Synthetic oligonucleotide
acacacaaggtcac

SEQ ID NO: 457 - DNA, 16 bp, Artificial Sequence
  Synthetic oligonucleotide
gctttttaaacacaca

SEQ ID NO: 458 - DNA, 14 bp, Artificial Sequence
  Synthetic oligonucleotide
ctttttaaacacac

SEQ ID NO: 459 - DNA, 16 bp, Artificial Sequence
  Synthetic oligonucleotide
tgacaagacacaatgg

SEQ ID NO: 460 - DNA, 14 bp, Artificial Sequence
  Synthetic oligonucleotide
gacaagacacaatg

SEQ ID NO: 461 - DNA, 16 bp, Artificial Sequence
  Synthetic oligonucleotide
ccaaactgccctcctg

SEQ ID NO: 462 - DNA, 16 bp, Artificial Sequence
  Synthetic oligonucleotide
ggtcagaaaagccaga

SEQ ID NO: 463 - DNA, 14 bp, Artificial Sequence
  Synthetic oligonucleotide
gtcagaaaagccag

SEQ ID NO: 464 - DNA, 14 bp, Artificial Sequence
  Synthetic oligonucleotide
ccactggatatcac

SEQ ID NO: 465 - DNA, 23 bp, Artificial Sequence
  Primer
gccacgttggtgtttcataatct

SEQ ID NO: 466 - DNA, 24 bp, Artificial Sequence
  Primer
gatagaggacattggactcttgca

SEQ ID NO: 467 - DNA, 29 bp, Artificial Sequence
  Probe
ttgggtgaaattgaccagcaatatagccg

SEQ ID NO: 468-470 - skipped (3 entries)

SEQ ID NO: 471 - DNA, 16 bp, Artificial Sequence
  Synthetic oligonucleotide
cgcagctccggaaacc

SEQ ID NO: 472 - DNA, 16 bp, Artificial Sequence
  Synthetic oligonucleotide
ccgcagctccggaaac

SEQ ID NO: 473 - DNA, 16 bp, Artificial Sequence
  Synthetic oligonucleotide
cgccgcagctccggaa

SEQ ID NO: 474 - DNA, 16 bp, Artificial Sequence
  Synthetic oligonucleotide
ccgccgcagctccgga

SEQ ID NO: 475 - DNA, 16 bp, Artificial Sequence
  Synthetic oligonucleotide
acccccggctccccct

SEQ ID NO: 476 - DNA, 16 bp, Artificial Sequence
  Synthetic oligonucleotide
gaacccccggctcccc

SEQ ID NO: 477 - DNA, 16 bp, Artificial Sequence
  Synthetic oligonucleotide
ggaacccccggctccc

SEQ ID NO: 478 - DNA, 16 bp, Artificial Sequence
  Synthetic oligonucleotide
cggaacccccggctcc

SEQ ID NO: 479 - DNA, 16 bp, Artificial Sequence
  Synthetic oligonucleotide
gtcggaacccccggct

SEQ ID NO: 480 - DNA, 16 bp, Artificial Sequence
  Synthetic oligonucleotide
cgtcggaacccccggc

SEQ ID NO: 481 - DNA, 16 bp, Artificial Sequence
  Synthetic oligonucleotide
ttgttccctcggctgc

SEQ ID NO: 482 - DNA, 16 bp, Artificial Sequence
  Synthetic oligonucleotide
cttgttccctcggctg

SEQ ID NO: 483 - DNA, 16 bp, Artificial Sequence
  Synthetic oligonucleotide
ggcttgttccctcggc

SEQ ID NO: 484 - DNA, 16 bp, Artificial Sequence
  Synthetic oligonucleotide
gggcttgttccctcgg

SEQ ID NO: 485 - DNA, 16 bp, Artificial Sequence
  Synthetic oligonucleotide
ccaggatccggttggg

SEQ ID NO: 486 - DNA, 16 bp, Artificial Sequence
  Synthetic oligonucleotide
gtccaggatccggttg

SEQ ID NO: 487 - DNA, 16 bp, Artificial Sequence
  Synthetic oligonucleotide
tgtccaggatccggtt

SEQ ID NO: 488 - DNA, 16 bp, Artificial Sequence
  Synthetic oligonucleotide
ctgtccaggatccggt

SEQ ID NO: 489 - DNA, 16 bp, Artificial Sequence
  Synthetic oligonucleotide
gcctgtccaggatccg

SEQ ID NO: 490 - DNA, 16 bp, Artificial Sequence
  Synthetic oligonucleotide
gtgcctgtccaggatc

SEQ ID NO: 491 - DNA, 16 bp, Artificial Sequence
  Synthetic oligonucleotide
agaggccgagaggccg

SEQ ID NO: 492 - DNA, 16 bp, Artificial Sequence
  Synthetic oligonucleotide
ggtcccaactgtttct

SEQ ID NO: 493 - DNA, 16 bp, Artificial Sequence
  Synthetic oligonucleotide
gggccatcctgctaaa

SEQ ID NO: 494 - DNA, 16 bp, Artificial Sequence
  Synthetic oligonucleotide
tgggccatcctgctaa

SEQ ID NO: 495 - DNA, 16 bp, Artificial Sequence
  Synthetic oligonucleotide
ttgggccatcctgcta

SEQ ID NO: 496 - DNA, 16 bp, Artificial Sequence
  Synthetic oligonucleotide
cattgggccatcctgc

SEQ ID NO: 497 - DNA, 16 bp, Artificial Sequence
  Synthetic oligonucleotide
ccattgggccatcctg

SEQ ID NO: 498 - DNA, 16 bp, Artificial Sequence
  Synthetic oligonucleotide
ttccattgggccatcc

SEQ ID NO: 499 - skipped

SEQ ID NO: 500 - DNA, 16 bp, Artificial Sequence
  Synthetic oligonucleotide
gctgattccattgggc

SEQ ID NO: 501 - DNA, 16 bp, Artificial Sequence
  Synthetic oligonucleotide
agctgattccattggg

SEQ ID NO: 502 - DNA, 16 bp, Artificial Sequence
  Synthetic oligonucleotide
tagctgattccattgg

SEQ ID NO: 503 - DNA, 16 bp, Artificial Sequence
  Synthetic oligonucleotide
gtagctgattccattg

SEQ ID NO: 504 - DNA, 16 bp, Artificial Sequence
  Synthetic oligonucleotide
gctgtagctgattcca

SEQ ID NO: 505 - DNA, 16 bp, Artificial Sequence
  Synthetic oligonucleotide
tgctgtagctgattcc

SEQ ID NO: 506 - DNA, 16 bp, Artificial Sequence
  Synthetic oligonucleotide
ctgctgtagctgattc

SEQ ID NO: 507 - DNA, 16 bp, Artificial Sequence
  Synthetic oligonucleotide
gctgctgtagctgatt

SEQ ID NO: 508 - DNA, 16 bp, Artificial Sequence
  Synthetic oligonucleotide
cgtgtgtcaagctgct

SEQ ID NO: 509 - DNA, 16 bp, Artificial Sequence
  Synthetic oligonucleotide
accgtgtgtcaagctg

SEQ ID NO: 510 - DNA, 16 bp, Artificial Sequence
  Synthetic oligonucleotide
taccgtgtgtcaagct

SEQ ID NO: 511 - DNA, 16 bp, Artificial Sequence
  Synthetic oligonucleotide
gtaccgtgtgtcaagc

SEQ ID NO: 512 - DNA, 16 bp, Artificial Sequence
  Synthetic oligonucleotide
ggtaccgtgtgtcaag

SEQ ID NO: 513 - DNA, 16 bp, Artificial Sequence
  Synthetic oligonucleotide
caggtaccgtgtgtca

SEQ ID NO: 514 - DNA, 16 bp, Artificial Sequence
  Synthetic oligonucleotide
ccaggtaccgtgtgtc

SEQ ID NO: 515 - DNA, 16 bp, Artificial Sequence
  Synthetic oligonucleotide
tccaggtaccgtgtgt

SEQ ID NO: 516 - DNA, 16 bp, Artificial Sequence
  Synthetic oligonucleotide
ctccaggtaccgtgtg

SEQ ID NO: 517 - DNA, 16 bp, Artificial Sequence
  Synthetic oligonucleotide
gctccaggtaccgtgt

SEQ ID NO: 518 - DNA, 16 bp, Artificial Sequence
  Synthetic oligonucleotide
tgctccaggtaccgtg

SEQ ID NO: 519 - DNA, 16 bp, Artificial Sequence
  Synthetic oligonucleotide
gtagagctgatggagc

SEQ ID NO: 520 - DNA, 16 bp, Artificial Sequence
  Synthetic oligonucleotide
tgtagagctgatggag

SEQ ID NO: 521 - DNA, 16 bp, Artificial Sequence
  Synthetic oligonucleotide
cactgtagagctgatg

SEQ ID NO: 522 - DNA, 16 bp, Artificial Sequence
  Synthetic oligonucleotide
gtcactgtagagctga

SEQ ID NO: 523 - DNA, 16 bp, Artificial Sequence
  Synthetic oligonucleotide
aagctgtcactgtaga

SEQ ID NO: 524 - DNA, 16 bp, Artificial Sequence
  Synthetic oligonucleotide
gaagctgtcactgtag

SEQ ID NO: 525 - DNA, 16 bp, Artificial Sequence
  Synthetic oligonucleotide
ttgggaagctgtcact

SEQ ID NO: 526 - DNA, 16 bp, Artificial Sequence
  Synthetic oligonucleotide
attgggaagctgtcac

SEQ ID NO: 527 - DNA, 16 bp, Artificial Sequence
  Synthetic oligonucleotide
ccattgggaagctgtc

SEQ ID NO: 528 - DNA, 16 bp, Artificial Sequence
  Synthetic oligonucleotide
gccagaaactgccgca

SEQ ID NO: 529 - DNA, 16 bp, Artificial Sequence
  Synthetic oligonucleotide
ggccagaaactgccgc

SEQ ID NO: 530 - DNA, 16 bp, Artificial Sequence
  Synthetic oligonucleotide
gggccagaaactgccg

SEQ ID NO: 531 - DNA, 16 bp, Artificial Sequence
  Synthetic oligonucleotide
actctcaatccaaggg

SEQ ID NO: 532 - DNA, 16 bp, Artificial Sequence
  Synthetic oligonucleotide
tgactctcaatccaag

SEQ ID NO: 533 - DNA, 16 bp, Artificial Sequence
  Synthetic oligonucleotide
atcttgactctcaatc

SEQ ID NO: 534 - DNA, 16 bp, Artificial Sequence
  Synthetic oligonucleotide
caatcttgactctcaa

SEQ ID NO: 535 - DNA, 16 bp, Artificial Sequence
  Synthetic oligonucleotide
ccaatcttgactctca

SEQ ID NO: 536 - DNA, 16 bp, Artificial Sequence
  Synthetic oligonucleotide
cccaatcttgactctc

SEQ ID NO: 537 - DNA, 16 bp, Artificial Sequence
  Synthetic oligonucleotide
gcccaatcttgactct

SEQ ID NO: 538 - DNA, 16 bp, Artificial Sequence
  Synthetic oligonucleotide
tgcccaatcttgactc

SEQ ID NO: 539 - DNA, 16 bp, Artificial Sequence
  Synthetic oligonucleotide
atgcccaatcttgact

SEQ ID NO: 540 - DNA, 16 bp, Artificial Sequence
  Synthetic oligonucleotide
tatgcccaatcttgac

SEQ ID NO: 541 - DNA, 16 bp, Artificial Sequence
  Synthetic oligonucleotide
gcatatgcccaatctt

SEQ ID NO: 542 - DNA, 16 bp, Artificial Sequence
  Synthetic oligonucleotide
cgcatatgcccaatct

SEQ ID NO: 543 - DNA, 16 bp, Artificial Sequence
  Synthetic oligonucleotide
tggccgcatatgccca

SEQ ID NO: 544 - DNA, 16 bp, Artificial Sequence
  Synthetic oligonucleotide
ctggccgcatatgccc

SEQ ID NO: 545 - DNA, 16 bp, Artificial Sequence
  Synthetic oligonucleotide
gctggccgcatatgcc

SEQ ID NO: 546 - DNA, 16 bp, Artificial Sequence
  Synthetic oligonucleotide
tgctggccgcatatgc

SEQ ID NO: 547 - DNA, 16 bp, Artificial Sequence
  Synthetic oligonucleotide
ttgctggccgcatatg

SEQ ID NO: 548 - DNA, 16 bp, Artificial Sequence
  Synthetic oligonucleotide
tttgctggccgcatat

SEQ ID NO: 549 - DNA, 16 bp, Artificial Sequence
  Synthetic oligonucleotide
ctttgctggccgcata

SEQ ID NO: 550 - DNA, 16 bp, Artificial Sequence
  Synthetic oligonucleotide
tctttgctggccgcat

SEQ ID NO: 551 - DNA, 16 bp, Artificial Sequence
  Synthetic oligonucleotide
attctttgctggccgc

SEQ ID NO: 552 - DNA, 16 bp, Artificial Sequence
  Synthetic oligonucleotide
tgattctttgctggcc

SEQ ID NO: 553 - DNA, 16 bp, Artificial Sequence
  Synthetic oligonucleotide
gtgattctttgctggc

SEQ ID NO: 554 - DNA, 16 bp, Artificial Sequence
  Synthetic oligonucleotide
gcatgtgattctttgc

SEQ ID NO: 555 - DNA, 16 bp, Artificial Sequence
  Synthetic oligonucleotide
ggcatgtgattctttg

SEQ ID NO: 556 - DNA, 16 bp, Artificial Sequence
  Synthetic oligonucleotide
aagtggcatgtgattc

SEQ ID NO: 557 - DNA, 16 bp, Artificial Sequence
  Synthetic oligonucleotide
ccaaagtggcatgtga

SEQ ID NO: 558 - DNA, 16 bp, Artificial Sequence
  Synthetic oligonucleotide
caccaaagtggcatgt

SEQ ID NO: 559 - DNA, 16 bp, Artificial Sequence
  Synthetic oligonucleotide
aacaccaaagtggcat

SEQ ID NO: 560 - DNA, 16 bp, Artificial Sequence
  Synthetic oligonucleotide
gaaacaccaaagtggc

SEQ ID NO: 561 - DNA, 16 bp, Artificial Sequence
  Synthetic oligonucleotide
actgctggtcaatctc

SEQ ID NO: 562 - DNA, 16 bp, Artificial Sequence
  Synthetic oligonucleotide
tactgctggtcaatct

SEQ ID NO: 563 - DNA, 16 bp, Artificial Sequence
  Synthetic oligonucleotide
tatactgctggtcaat

SEQ ID NO: 564 - DNA, 16 bp, Artificial Sequence
  Synthetic oligonucleotide
ctatactgctggtcaa

SEQ ID NO: 565 - DNA, 16 bp, Artificial Sequence
  Synthetic oligonucleotide
gctatactgctggtca

SEQ ID NO: 566 - DNA, 16 bp, Artificial Sequence
  Synthetic oligonucleotide
ggctatactgctggtc

SEQ ID NO: 567 - DNA, 16 bp, Artificial Sequence
  Synthetic oligonucleotide
cggctatactgctggt

SEQ ID NO: 568 - DNA, 16 bp, Artificial Sequence
  Synthetic oligonucleotide
gcggctatactgctgg

SEQ ID NO: 569 - DNA, 16 bp, Artificial Sequence
  Synthetic oligonucleotide
agcggctatactgctg

SEQ ID NO: 570 - DNA, 16 bp, Artificial Sequence
  Synthetic oligonucleotide
aagcggctatactgct

SEQ ID NO: 571 - DNA, 16 bp, Artificial Sequence
  Synthetic oligonucleotide
ggaagcggctatactg

SEQ ID NO: 572 - DNA, 16 bp, Artificial Sequence
  Synthetic oligonucleotide
aggaagcggctatact

SEQ ID NO: 573 - DNA, 16 bp, Artificial Sequence
  Synthetic oligonucleotide
caggaagcggctatac

SEQ ID NO: 574 - DNA, 16 bp, Artificial Sequence
  Synthetic oligonucleotide
gcaggaagcggctata

SEQ ID NO: 575 - DNA, 16 bp, Artificial Sequence
  Synthetic oligonucleotide
tgcaggaagcggctat

SEQ ID NO: 576 - DNA, 16 bp, Artificial Sequence
  Synthetic oligonucleotide
ttgcaggaagcggcta

SEQ ID NO: 577 - DNA, 16 bp, Artificial Sequence
  Synthetic oligonucleotide
cttgcaggaagcggct

SEQ ID NO: 578 - DNA, 16 bp, Artificial Sequence
  Synthetic oligonucleotide
gatagagaacattcga

SEQ ID NO: 579 - DNA, 16 bp, Artificial Sequence
  Synthetic oligonucleotide
tgatagagaacattcg

SEQ ID NO: 580 - DNA, 16 bp, Artificial Sequence
  Synthetic oligonucleotide
tgtgctgatagagaac

SEQ ID NO: 581 - DNA, 16 bp, Artificial Sequence
  Synthetic oligonucleotide
attgtgctgatagaga

SEQ ID NO: 582 - DNA, 16 bp, Artificial Sequence
  Synthetic oligonucleotide
gattgtgctgatagag

SEQ ID NO: 583 - DNA, 16 bp, Artificial Sequence
  Synthetic oligonucleotide
agattgtgctgataga

SEQ ID NO: 584 - DNA, 16 bp, Artificial Sequence
  Synthetic oligonucleotide
gtagattgtgctgata

SEQ ID NO: 585 - DNA, 16 bp, Artificial Sequence
  Synthetic oligonucleotide
cgtagattgtgctgat

SEQ ID NO: 586 - DNA, 16 bp, Artificial Sequence
  Synthetic oligonucleotide
tcaagatacctgctct

SEQ ID NO: 587 - DNA, 16 bp, Artificial Sequence
  Synthetic oligonucleotide
ctcaagatacctgctc

SEQ ID NO: 588 - DNA, 16 bp, Artificial Sequence
  Synthetic oligonucleotide
tctcaagatacctgct

SEQ ID NO: 589 - DNA, 16 bp, Artificial Sequence
  Synthetic oligonucleotide
gcttctcaagatacct

SEQ ID NO: 590 - DNA, 16 bp, Artificial Sequence
  Synthetic oligonucleotide
tggcttctcaagatac

SEQ ID NO: 591 - DNA, 16 bp, Artificial Sequence
  Synthetic oligonucleotide
cattggcttctcaaga

SEQ ID NO: 592 - DNA, 16 bp, Artificial Sequence
  Synthetic oligonucleotide
ccattggcttctcaag

SEQ ID NO: 593 - DNA, 16 bp, Artificial Sequence
  Synthetic oligonucleotide
gcaatctccattggct

SEQ ID NO: 594 - DNA, 16 bp, Artificial Sequence
  Synthetic oligonucleotide
ggcaatctccattggc

SEQ ID NO: 595 - DNA, 16 bp, Artificial Sequence
  Synthetic oligonucleotide
gggcaatctccattgg

SEQ ID NO: 596 - DNA, 16 bp, Artificial Sequence
  Synthetic oligonucleotide
cgggcaatctccattg

SEQ ID NO: 597 - DNA, 16 bp, Artificial Sequence
  Synthetic oligonucleotide
ccgggcaatctccatt

SEQ ID NO: 598 - DNA, 16 bp, Artificial Sequence
  Synthetic oligonucleotide
tccgggcaatctccat

SEQ ID NO: 599 - DNA, 16 bp, Artificial Sequence
  Synthetic oligonucleotide
atccgggcaatctcca

SEQ ID NO: 600 - DNA, 16 bp, Artificial Sequence
  Synthetic oligonucleotide
aatccgggcaatctcc

SEQ ID NO: 601 - DNA, 16 bp, Artificial Sequence
  Synthetic oligonucleotide
caatccgggcaatctc

SEQ ID NO: 602 - DNA, 16 bp, Artificial Sequence
  Synthetic oligonucleotide
acaatccgggcaatct

SEQ ID NO: 603 - DNA, 16 bp, Artificial Sequence
  Synthetic oligonucleotide
cacaatccgggcaatc

SEQ ID NO: 604 - DNA, 16 bp, Artificial Sequence
  Synthetic oligonucleotide
ccacaatccgggcaat

SEQ ID NO: 605 - DNA, 16 bp, Artificial Sequence
  Synthetic oligonucleotide
ggccacaatccgggca

SEQ ID NO: 606 - DNA, 16 bp, Artificial Sequence
  Synthetic oligonucleotide
ccgggccacaatccgg

SEQ ID NO: 607 - DNA, 16 bp, Artificial Sequence
  Synthetic oligonucleotide
accgggccacaatccg

SEQ ID NO: 608 - DNA, 16 bp, Artificial Sequence
  Synthetic oligonucleotide
caccgggccacaatcc

SEQ ID NO: 609 - DNA, 16 bp, Artificial Sequence
  Synthetic oligonucleotide
gcaccgggccacaatc

SEQ ID NO: 610 - DNA, 16 bp, Artificial Sequence
  Synthetic oligonucleotide
ggcaccgggccacaat

SEQ ID NO: 611 - DNA, 16 bp, Artificial Sequence
  Synthetic oligonucleotide
aggcaccgggccacaa

SEQ ID NO: 612 - DNA, 16 bp, Artificial Sequence
  Synthetic oligonucleotide
ttcccacaggcaccgg

SEQ ID NO: 613 - DNA, 16 bp, Artificial Sequence
  Synthetic oligonucleotide
tggctgcagtctgtag

SEQ ID NO: 614 - DNA, 16 bp, Artificial Sequence
  Synthetic oligonucleotide
ccgcagtggctgcagt

SEQ ID NO: 615 - DNA, 16 bp, Artificial Sequence
  Synthetic oligonucleotide
tgctgggccgcagtgg

SEQ ID NO: 616 - DNA, 16 bp, Artificial Sequence
  Synthetic oligonucleotide
cttgctgggccgcagt

SEQ ID NO: 617 - DNA, 16 bp, Artificial Sequence
  Synthetic oligonucleotide
cccttgctgggccgca

SEQ ID NO: 618 - DNA, 16 bp, Artificial Sequence
  Synthetic oligonucleotide
ccccttgctgggccgc

SEQ ID NO: 619 - DNA, 16 bp, Artificial Sequence
  Synthetic oligonucleotide
cccccttgctgggccg

SEQ ID NO: 620 - DNA, 16 bp, Artificial Sequence
  Synthetic oligonucleotide
tggcccccttgctggg

SEQ ID NO: 621 - DNA, 16 bp, Artificial Sequence
  Synthetic oligonucleotide
gttggcctggccccct

SEQ ID NO: 622 - DNA, 16 bp, Artificial Sequence
  Synthetic oligonucleotide
ggttggcctggccccc

SEQ ID NO: 623 - DNA, 16 bp, Artificial Sequence
  Synthetic oligonucleotide
tggttggcctggcccc

SEQ ID NO: 624 - DNA, 16 bp, Artificial Sequence
  Synthetic oligonucleotide
gcttctccgtcaccac

SEQ ID NO: 625 - DNA, 16 bp, Artificial Sequence
  Synthetic oligonucleotide
tgcttctccgtcacca

SEQ ID NO: 626 - DNA, 16 bp, Artificial Sequence
  Synthetic oligonucleotide
gctgcttctccgtcac

SEQ ID NO: 627 - DNA, 16 bp, Artificial Sequence
  Synthetic oligonucleotide
ggtgctgctccagcat

SEQ ID NO: 628 - DNA, 16 bp, Artificial Sequence
  Synthetic oligonucleotide
gacatcctgaaggtgc

SEQ ID NO: 629 - DNA, 16 bp, Artificial Sequence
  Synthetic oligonucleotide
tccggacatcctgaag

SEQ ID NO: 630 - DNA, 16 bp, Artificial Sequence
  Synthetic oligonucleotide
ttccggacatcctgaa

SEQ ID NO: 631 - DNA, 16 bp, Artificial Sequence
  Synthetic oligonucleotide
cttccggacatcctga

SEQ ID NO: 632 - DNA, 16 bp, Artificial Sequence
  Synthetic oligonucleotide
tcttccggacatcctg

SEQ ID NO: 633 - DNA, 16 bp, Artificial Sequence
  Synthetic oligonucleotide
ctcttccggacatcct

SEQ ID NO: 634 - DNA, 16 bp, Artificial Sequence
  Synthetic oligonucleotide
tctcttccggacatcc

SEQ ID NO: 635 - DNA, 16 bp, Artificial Sequence
  Synthetic oligonucleotide
ctctcttccggacatc

SEQ ID NO: 636 - DNA, 16 bp, Artificial Sequence
  Synthetic oligonucleotide
actctcttccggacat

SEQ ID NO: 637 - DNA, 16 bp, Artificial Sequence
  Synthetic oligonucleotide
gattctctaccacttt

SEQ ID NO: 638 - DNA, 16 bp, Artificial Sequence
  Synthetic oligonucleotide
tggagattctctacca

SEQ ID NO: 639 - DNA, 16 bp, Artificial Sequence
  Synthetic oligonucleotide
ctggagattctctacc

SEQ ID NO: 640 - DNA, 16 bp, Artificial Sequence
  Synthetic oligonucleotide
cctggagattctctac

SEQ ID NO: 641 - DNA, 16 bp, Artificial Sequence
  Synthetic oligonucleotide
gtcatcctggagattc

SEQ ID NO: 642 - DNA, 16 bp, Artificial Sequence
  Synthetic oligonucleotide
ttgagggttttatagt

SEQ ID NO: 643 - DNA, 16 bp, Artificial Sequence
  Synthetic oligonucleotide
ctccttgactcttgag

SEQ ID NO: 644 - DNA, 16 bp, Artificial Sequence
  Synthetic oligonucleotide
gcatgtctccttgact

SEQ ID NO: 645 - DNA, 16 bp, Artificial Sequence
  Synthetic oligonucleotide
tgcatgtctccttgac

SEQ ID NO: 646 - DNA, 16 bp, Artificial Sequence
  Synthetic oligonucleotide
ttgcatgtctccttga

SEQ ID NO: 647 - DNA, 16 bp, Artificial Sequence
  Synthetic oligonucleotide
gatcttgcatgtctcc

SEQ ID NO: 648 - DNA, 16 bp, Artificial Sequence
  Synthetic oligonucleotide
tcagatcttgcatgtc

SEQ ID NO: 649 - DNA, 16 bp, Artificial Sequence
  Synthetic oligonucleotide
attcagatcttgcatg

SEQ ID NO: 650 - DNA, 16 bp, Artificial Sequence
  Synthetic oligonucleotide
ccattcagatcttgca

SEQ ID NO: 651 - DNA, 16 bp, Artificial Sequence
  Synthetic oligonucleotide
tccattcagatcttgc

SEQ ID NO: 652 - DNA, 16 bp, Artificial Sequence
  Synthetic oligonucleotide
ttccattcagatcttg

SEQ ID NO: 653 - DNA, 16 bp, Artificial Sequence
  Synthetic oligonucleotide
tggttgtttccattca

SEQ ID NO: 654 - DNA, 16 bp, Artificial Sequence
  Synthetic oligonucleotide
ctggttgtttccattc

SEQ ID NO: 655 - DNA, 16 bp, Artificial Sequence
  Synthetic oligonucleotide
gactggttgtttccat

SEQ ID NO: 656 - DNA, 16 bp, Artificial Sequence
  Synthetic oligonucleotide
tgactggttgtttcca

SEQ ID NO: 657 - DNA, 16 bp, Artificial Sequence
  Synthetic oligonucleotide
ggtcactgactggttg

SEQ ID NO: 658 - DNA, 16 bp, Artificial Sequence
  Synthetic oligonucleotide
tggtcactgactggtt

SEQ ID NO: 659 - DNA, 16 bp, Artificial Sequence
  Synthetic oligonucleotide
gtgagcatctgttcca

SEQ ID NO: 660 - DNA, 16 bp, Artificial Sequence
  Synthetic oligonucleotide
cgcagtgagcatctgt

SEQ ID NO: 661 - DNA, 16 bp, Artificial Sequence
  Synthetic oligonucleotide
gcgcagtgagcatctg

SEQ ID NO: 662 - DNA, 16 bp, Artificial Sequence
  Synthetic oligonucleotide
agcgcagtgagcatct

SEQ ID NO: 663 - DNA, 16 bp, Artificial Sequence
  Synthetic oligonucleotide
cagcgcagtgagcatc

SEQ ID NO: 664 - DNA, 16 bp, Artificial Sequence
  Synthetic oligonucleotide
tccagcgcagtgagca

SEQ ID NO: 665 - DNA, 16 bp, Artificial Sequence
  Synthetic oligonucleotide
gtccagcgcagtgagc

SEQ ID NO: 666 - DNA, 16 bp, Artificial Sequence
  Synthetic oligonucleotide
ggtccagcgcagtgag

SEQ ID NO: 667 - DNA, 16 bp, Artificial Sequence
  Synthetic oligonucleotide
tggtccagcgcagtga

SEQ ID NO: 668 - DNA, 16 bp, Artificial Sequence
  Synthetic oligonucleotide
tctggtccagcgcagt

SEQ ID NO: 669 - DNA, 16 bp, Artificial Sequence
  Synthetic oligonucleotide
atctggtccagcgcag

SEQ ID NO: 670 - DNA, 16 bp, Artificial Sequence
  Synthetic oligonucleotide
catctggtccagcgca

SEQ ID NO: 671 - DNA, 16 bp, Artificial Sequence
  Synthetic oligonucleotide
gcatctggtccagcgc

SEQ ID NO: 672 - DNA, 16 bp, Artificial Sequence
  Synthetic oligonucleotide
ccgcatctggtccagc

SEQ ID NO: 673 - DNA, 16 bp, Artificial Sequence
  Synthetic oligonucleotide
ctccgcatctggtcca

SEQ ID NO: 674 - DNA, 16 bp, Artificial Sequence
  Synthetic oligonucleotide
tctccgcatctggtcc

SEQ ID NO: 675 - DNA, 16 bp, Artificial Sequence
  Synthetic oligonucleotide
ttctccgcatctggtc

SEQ ID NO: 676 - DNA, 16 bp, Artificial Sequence
  Synthetic oligonucleotide
cttctccgcatctggt

SEQ ID NO: 677 - DNA, 16 bp, Artificial Sequence
  Synthetic oligonucleotide
gcttctccgcatctgg

SEQ ID NO: 678 - DNA, 16 bp, Artificial Sequence
  Synthetic oligonucleotide
atgcttctccgcatct

SEQ ID NO: 679 - DNA, 16 bp, Artificial Sequence
  Synthetic oligonucleotide
gatgcttctccgcatc

SEQ ID NO: 680 - DNA, 16 bp, Artificial Sequence
  Synthetic oligonucleotide
cgatgcttctccgcat

SEQ ID NO: 681 - DNA, 16 bp, Artificial Sequence
  Synthetic oligonucleotide
acgatgcttctccgca

SEQ ID NO: 682 - DNA, 16 bp, Artificial Sequence
  Synthetic oligonucleotide
cacgatgcttctccgc

SEQ ID NO: 683 - DNA, 16 bp, Artificial Sequence
  Synthetic oligonucleotide
tcacgatgcttctccg

SEQ ID NO: 684 - DNA, 16 bp, Artificial Sequence
  Synthetic oligonucleotide
ctcacgatgcttctcc

SEQ ID NO: 685 - DNA, 16 bp, Artificial Sequence
  Synthetic oligonucleotide
actcacgatgcttctc

SEQ ID NO: 686 - DNA, 16 bp, Artificial Sequence
  Synthetic oligonucleotide
cactcacgatgcttct

SEQ ID NO: 687 - DNA, 16 bp, Artificial Sequence
  Synthetic oligonucleotide
ctcactcacgatgctt

SEQ ID NO: 688 - DNA, 16 bp, Artificial Sequence
  Synthetic oligonucleotide
gctcactcacgatgct

SEQ ID NO: 689 - DNA, 16 bp, Artificial Sequence
  Synthetic oligonucleotide
cagctcactcacgatg

SEQ ID NO: 690 - DNA, 16 bp, Artificial Sequence
  Synthetic oligonucleotide
ccagctcactcacgat

SEQ ID NO: 691 - DNA, 16 bp, Artificial Sequence
  Synthetic oligonucleotide
gccagctcactcacga

SEQ ID NO: 692 - DNA, 16 bp, Artificial Sequence
  Synthetic oligonucleotide
cgccagctcactcacg

SEQ ID NO: 693 - DNA, 16 bp, Artificial Sequence
  Synthetic oligonucleotide
aatttgttgacgggtc

SEQ ID NO: 694 - DNA, 16 bp, Artificial Sequence
  Synthetic oligonucleotide
taatttgttgacgggt

SEQ ID NO: 695 - DNA, 16 bp, Artificial Sequence
  Synthetic oligonucleotide
ttaatttgttgacggg

SEQ ID NO: 696 - DNA, 16 bp, Artificial Sequence
  Synthetic oligonucleotide
tcttaatttgttgacg

SEQ ID NO: 697 - DNA, 16 bp, Artificial Sequence
  Synthetic oligonucleotide
gcaactcctccagttt

SEQ ID NO: 698 - DNA, 16 bp, Artificial Sequence
  Synthetic oligonucleotide
tgcaactcctccagtt

SEQ ID NO: 699 - DNA, 16 bp, Artificial Sequence
  Synthetic oligonucleotide
ttttgctgcaactcct

SEQ ID NO: 700 - DNA, 16 bp, Artificial Sequence
  Synthetic oligonucleotide
tttttgctgcaactcc

SEQ ID NO: 701 - DNA, 16 bp, Artificial Sequence
  Synthetic oligonucleotide
ggtcccctttgtagga

SEQ ID NO: 702 - DNA, 16 bp, Artificial Sequence
  Synthetic oligonucleotide
gggtcccctttgtagg

SEQ ID NO: 703 - DNA, 16 bp, Artificial Sequence
  Synthetic oligonucleotide
ggtgctgtacaatggg

SEQ ID NO: 704 - DNA, 16 bp, Artificial Sequence
  Synthetic oligonucleotide
cggtgctgtacaatgg

SEQ ID NO: 705 - DNA, 16 bp, Artificial Sequence
  Synthetic oligonucleotide
ccggtgctgtacaatg

SEQ ID NO: 706 - DNA, 16 bp, Artificial Sequence
  Synthetic oligonucleotide
gccggtgctgtacaat

SEQ ID NO: 707 - DNA, 16 bp, Artificial Sequence
  Synthetic oligonucleotide
ggccggtgctgtacaa

SEQ ID NO: 708 - DNA, 16 bp, Artificial Sequence
  Synthetic oligonucleotide
cggccggtgctgtaca

SEQ ID NO: 709 - DNA, 16 bp, Artificial Sequence
  Synthetic oligonucleotide
atcggccggtgctgta

SEQ ID NO: 710 - DNA, 16 bp, Artificial Sequence
  Synthetic oligonucleotide
catcggccggtgctgt

SEQ ID NO: 711 - DNA, 16 bp, Artificial Sequence
  Synthetic oligonucleotide
gcatcggccggtgctg

SEQ ID NO: 712 - DNA, 16 bp, Artificial Sequence
  Synthetic oligonucleotide
agcatcggccggtgct

SEQ ID NO: 713 - DNA, 16 bp, Artificial Sequence
  Synthetic oligonucleotide
cagcatcggccggtgc

SEQ ID NO: 714 - DNA, 16 bp, Artificial Sequence
  Synthetic oligonucleotide
ccagcatcggccggtg

SEQ ID NO: 715 - DNA, 16 bp, Artificial Sequence
  Synthetic oligonucleotide
tccagcatcggccggt

SEQ ID NO: 716 - DNA, 16 bp, Artificial Sequence
  Synthetic oligonucleotide
cctccagcatcggccg

SEQ ID NO: 717 - DNA, 16 bp, Artificial Sequence
  Synthetic oligonucleotide
ctcctccagcatcggc

SEQ ID NO: 718 - DNA, 16 bp, Artificial Sequence
  Synthetic oligonucleotide
tctcctccagcatcgg

SEQ ID NO: 719 - DNA, 16 bp, Artificial Sequence
  Synthetic oligonucleotide
cgattctctcctccag

SEQ ID NO: 720 - DNA, 16 bp, Artificial Sequence
  Synthetic oligonucleotide
acgattctctcctcca

SEQ ID NO: 721 - DNA, 16 bp, Artificial Sequence
  Synthetic oligonucleotide
cacgattctctcctcc

SEQ ID NO: 722 - DNA, 16 bp, Artificial Sequence
  Synthetic oligonucleotide
ccacgattctctcctc

SEQ ID NO: 723 - DNA, 16 bp, Artificial Sequence
  Synthetic oligonucleotide
tccacgattctctcct

SEQ ID NO: 724 - DNA, 16 bp, Artificial Sequence
  Synthetic oligonucleotide
ctccacgattctctcc

SEQ ID NO: 725 - DNA, 16 bp, Artificial Sequence
  Synthetic oligonucleotide
gctccacgattctctc

SEQ ID NO: 726 - DNA, 16 bp, Artificial Sequence
  Synthetic oligonucleotide
agctccacgattctct

SEQ ID NO: 727 - DNA, 16 bp, Artificial Sequence
  Synthetic oligonucleotide
cagctccacgattctc

SEQ ID NO: 728 - DNA, 16 bp, Artificial Sequence
  Synthetic oligonucleotide
acagctccacgattct

SEQ ID NO: 729 - DNA, 16 bp, Artificial Sequence
  Synthetic oligonucleotide
aacagctccacgattc

SEQ ID NO: 730 - DNA, 16 bp, Artificial Sequence
  Synthetic oligonucleotide
gcacttttcattaagt

SEQ ID NO: 731 - DNA, 16 bp, Artificial Sequence
  Synthetic oligonucleotide
ggcacttttcattaag

SEQ ID NO: 732 - DNA, 16 bp, Artificial Sequence
  Synthetic oligonucleotide
cgctccaccacaaagg

SEQ ID NO: 733 - DNA, 16 bp, Artificial Sequence
  Synthetic oligonucleotide
ggctgccgctccacca

SEQ ID NO: 734 - DNA, 16 bp, Artificial Sequence
  Synthetic oligonucleotide
gggctgccgctccacc

SEQ ID NO: 735 - DNA, 16 bp, Artificial Sequence
  Synthetic oligonucleotide
agggctgccgctccac

SEQ ID NO: 736 - DNA, 16 bp, Artificial Sequence
  Synthetic oligonucleotide
cagggctgccgctcca

SEQ ID NO: 737 - DNA, 16 bp, Artificial Sequence
  Synthetic oligonucleotide
atgcagggctgccgct

SEQ ID NO: 738 - DNA, 16 bp, Artificial Sequence
  Synthetic oligonucleotide
catgcagggctgccgc

SEQ ID NO: 739 - DNA, 16 bp, Artificial Sequence
  Synthetic oligonucleotide
atgcatgggcatgcag

SEQ ID NO: 740 - DNA, 16 bp, Artificial Sequence
  Synthetic oligonucleotide
gatgcatgggcatgca

SEQ ID NO: 741 - DNA, 16 bp, Artificial Sequence
  Synthetic oligonucleotide
ggatgcatgggcatgc

SEQ ID NO: 742 - DNA, 16 bp, Artificial Sequence
  Synthetic oligonucleotide
cgccggtcttgatgac

SEQ ID NO: 743 - DNA, 16 bp, Artificial Sequence
  Synthetic oligonucleotide
acgccggtcttgatga

SEQ ID NO: 744 - DNA, 16 bp, Artificial Sequence
  Synthetic oligonucleotide
gtagtgaactggacgc

SEQ ID NO: 745 - DNA, 16 bp, Artificial Sequence
  Synthetic oligonucleotide
gaccagcaacctgact

SEQ ID NO: 746 - DNA, 16 bp, Artificial Sequence
  Synthetic oligonucleotide
tgaccagcaacctgac

SEQ ID NO: 747 - DNA, 16 bp, Artificial Sequence
  Synthetic oligonucleotide
atttgaccagcaacct

SEQ ID NO: 748 - DNA, 16 bp, Artificial Sequence
  Synthetic oligonucleotide
aatttgaccagcaacc

SEQ ID NO: 749 - DNA, 16 bp, Artificial Sequence
  Synthetic oligonucleotide
gaatttgaccagcaac

SEQ ID NO: 750 - DNA, 16 bp, Artificial Sequence
  Synthetic oligonucleotide
agggaatttgaccagc

SEQ ID NO: 751 - DNA, 16 bp, Artificial Sequence
  Synthetic oligonucleotide
cagggaatttgaccag

SEQ ID NO: 752 - DNA, 16 bp, Artificial Sequence
  Synthetic oligonucleotide
tcagggaatttgacca

SEQ ID NO: 753 - DNA, 16 bp, Artificial Sequence
  Synthetic oligonucleotide
ctcagggaatttgacc

SEQ ID NO: 754 - DNA, 16 bp, Artificial Sequence
  Synthetic oligonucleotide
ctttgtcaatgcacac

SEQ ID NO: 755 - DNA, 16 bp, Artificial Sequence
  Synthetic oligonucleotide
gtctttgtcaatgcac

SEQ ID NO: 756 - DNA, 16 bp, Artificial Sequence
  Synthetic oligonucleotide
agtctttgtcaatgca

SEQ ID NO: 757 - DNA, 16 bp, Artificial Sequence
  Synthetic oligonucleotide
ccagagtctttgtcaa

SEQ ID NO: 758 - DNA, 16 bp, Artificial Sequence
  Synthetic oligonucleotide
ccccagagtctttgtc

SEQ ID NO: 759 - DNA, 16 bp, Artificial Sequence
  Synthetic oligonucleotide
ccgggatcctctgaga

SEQ ID NO: 760 - DNA, 16 bp, Artificial Sequence
  Synthetic oligonucleotide
tccgggatcctctgag

SEQ ID NO: 761 - DNA, 16 bp, Artificial Sequence
  Synthetic oligonucleotide
ttccgggatcctctga

SEQ ID NO: 762 - DNA, 16 bp, Artificial Sequence
  Synthetic oligonucleotide
tttccgggatcctctg

SEQ ID NO: 763 - DNA, 16 bp, Artificial Sequence
  Synthetic oligonucleotide
atttccgggatcctct

SEQ ID NO: 764 - DNA, 16 bp, Artificial Sequence
  Synthetic oligonucleotide
aatttccgggatcctc

SEQ ID NO: 765 - DNA, 16 bp, Artificial Sequence
  Synthetic oligonucleotide
aaatttccgggatcct

SEQ ID NO: 766 - DNA, 16 bp, Artificial Sequence
  Synthetic oligonucleotide
ttaaatttccgggatc

SEQ ID NO: 767 - DNA, 16 bp, Artificial Sequence
  Synthetic oligonucleotide
gttaaatttccgggat

SEQ ID NO: 768 - DNA, 16 bp, Artificial Sequence
  Synthetic oligonucleotide
tgttaaatttccggga

SEQ ID NO: 769 - DNA, 16 bp, Artificial Sequence
  Synthetic oligonucleotide
atgttaaatttccggg

SEQ ID NO: 770 - DNA, 16 bp, Artificial Sequence
  Synthetic oligonucleotide
gaatgttaaatttccg

SEQ ID NO: 771 - DNA, 16 bp, Artificial Sequence
  Synthetic oligonucleotide
tgtgcccagaatgtta

SEQ ID NO: 772 - DNA, 16 bp, Artificial Sequence
  Synthetic oligonucleotide
ggctgccgttgttgga

SEQ ID NO: 773 - DNA, 16 bp, Artificial Sequence
  Synthetic oligonucleotide
aggctgccgttgttgg

SEQ ID NO: 774 - DNA, 16 bp, Artificial Sequence
  Synthetic oligonucleotide
agaggctgccgttgtt

SEQ ID NO: 775 - DNA, 16 bp, Artificial Sequence
  Synthetic oligonucleotide
gagaggctgccgttgt

SEQ ID NO: 776 - DNA, 16 bp, Artificial Sequence
  Synthetic oligonucleotide
agagaggctgccgttg

SEQ ID NO: 777 - DNA, 16 bp, Artificial Sequence
  Synthetic oligonucleotide
cagagaggctgccgtt

SEQ ID NO: 778 - DNA, 16 bp, Artificial Sequence
  Synthetic oligonucleotide
ggtcaagtgtttgaat

SEQ ID NO: 779 - DNA, 16 bp, Artificial Sequence
  Synthetic oligonucleotide
gctccctcagggtcaa

SEQ ID NO: 780 - DNA, 16 bp, Artificial Sequence
  Synthetic oligonucleotide
gctcggcccccattcc

SEQ ID NO: 781 - DNA, 16 bp, Artificial Sequence
  Synthetic oligonucleotide
ggctcggcccccattc

SEQ ID NO: 782 - DNA, 16 bp, Artificial Sequence
  Synthetic oligonucleotide
tggctcggcccccatt

SEQ ID NO: 783 - DNA, 16 bp, Artificial Sequence
  Synthetic oligonucleotide
ttggctcggcccccat

SEQ ID NO: 784 - DNA, 16 bp, Artificial Sequence
  Synthetic oligonucleotide
caatcagggaagcatc

SEQ ID NO: 785 - DNA, 16 bp, Artificial Sequence
  Synthetic oligonucleotide
gtcacaatcagggaag

SEQ ID NO: 786 - DNA, 16 bp, Artificial Sequence
  Synthetic oligonucleotide
cagtcacaatcaggga

SEQ ID NO: 787 - DNA, 16 bp, Artificial Sequence
  Synthetic oligonucleotide
tcagtcacaatcaggg

SEQ ID NO: 788 - DNA, 16 bp, Artificial Sequence
  Synthetic oligonucleotide
tcctcagtcacaatca

SEQ ID NO: 789 - DNA, 16 bp, Artificial Sequence
  Synthetic oligonucleotide
ggtgcagctcctcagt

SEQ ID NO: 790 - DNA, 16 bp, Artificial Sequence
  Synthetic oligonucleotide
tgatcaggtgcagctc

SEQ ID NO: 791 - DNA, 16 bp, Artificial Sequence
  Synthetic oligonucleotide
gtgatcaggtgcagct

SEQ ID NO: 792 - DNA, 16 bp, Artificial Sequence
  Synthetic oligonucleotide
ggtgatcaggtgcagc

SEQ ID NO: 793 - DNA, 16 bp, Artificial Sequence
  Synthetic oligonucleotide
tgaggccttggtgata

SEQ ID NO: 794 - DNA, 16 bp, Artificial Sequence
  Synthetic oligonucleotide
cttgaggccttggtga

SEQ ID NO: 795 - DNA, 16 bp, Artificial Sequence
  Synthetic oligonucleotide
atcttgaggccttggt

SEQ ID NO: 796 - DNA, 16 bp, Artificial Sequence
  Synthetic oligonucleotide
aatcttgaggccttgg

SEQ ID NO: 797 - DNA, 16 bp, Artificial Sequence
  Synthetic oligonucleotide
caatcttgaggccttg

SEQ ID NO: 798 - DNA, 16 bp, Artificial Sequence
  Synthetic oligonucleotide
tcaatcttgaggcctt

SEQ ID NO: 799 - DNA, 16 bp, Artificial Sequence
  Synthetic oligonucleotide
gtcaatcttgaggcct

SEQ ID NO: 800 - DNA, 16 bp, Artificial Sequence
  Synthetic oligonucleotide
ggtcaatcttgaggcc

SEQ ID NO: 801 - DNA, 16 bp, Artificial Sequence
  Synthetic oligonucleotide
aggtcaatcttgaggc

SEQ ID NO: 802 - DNA, 16 bp, Artificial Sequence
  Synthetic oligonucleotide
taggtcaatcttgagg

SEQ ID NO: 803 - DNA, 16 bp, Artificial Sequence
  Synthetic oligonucleotide
ctaggtcaatcttgag

SEQ ID NO: 804 - DNA, 16 bp, Artificial Sequence
  Synthetic oligonucleotide
ctctaggtcaatcttg

SEQ ID NO: 805 - DNA, 16 bp, Artificial Sequence
  Synthetic oligonucleotide
gtctctaggtcaatct

SEQ ID NO: 806 - DNA, 16 bp, Artificial Sequence
  Synthetic oligonucleotide
gggtctctaggtcaat

SEQ ID NO: 807 - DNA, 16 bp, Artificial Sequence
  Synthetic oligonucleotide
tgggtctctaggtcaa

SEQ ID NO: 808 - DNA, 16 bp, Artificial Sequence
  Synthetic oligonucleotide
gtgggtctctaggtca

SEQ ID NO: 809 - DNA, 16 bp, Artificial Sequence
  Synthetic oligonucleotide
agtgggtctctaggtc

SEQ ID NO: 810 - DNA, 16 bp, Artificial Sequence
  Synthetic oligonucleotide
aggagtgggtctctag

SEQ ID NO: 811 - DNA, 16 bp, Artificial Sequence
  Synthetic oligonucleotide
aaggagtgggtctcta

SEQ ID NO: 812 - DNA, 16 bp, Artificial Sequence
  Synthetic oligonucleotide
caaggagtgggtctct

SEQ ID NO: 813 - DNA, 16 bp, Artificial Sequence
  Synthetic oligonucleotide
caactggcaaggagtg

SEQ ID NO: 814 - DNA, 16 bp, Artificial Sequence
  Synthetic oligonucleotide
acagatgttggagatc

SEQ ID NO: 815 - DNA, 16 bp, Artificial Sequence
  Synthetic oligonucleotide
ctgacagatgttggag

SEQ ID NO: 816 - DNA, 16 bp, Artificial Sequence
  Synthetic oligonucleotide
cgcccaggcatttggc

SEQ ID NO: 817 - DNA, 16 bp, Artificial Sequence
  Synthetic oligonucleotide
acgcccaggcatttgg

SEQ ID NO: 818 - DNA, 16 bp, Artificial Sequence
  Synthetic oligonucleotide
ggtcagcatgttgtac

SEQ ID NO: 819 - DNA, 16 bp, Artificial Sequence
  Synthetic oligonucleotide
tggtcagcatgttgta

SEQ ID NO: 820 - DNA, 16 bp, Artificial Sequence
  Synthetic oligonucleotide
gttggtcagcatgttg

SEQ ID NO: 821 - DNA, 16 bp, Artificial Sequence
  Synthetic oligonucleotide
ttgttggtcagcatgt

SEQ ID NO: 822 - DNA, 16 bp, Artificial Sequence
  Synthetic oligonucleotide
gcttggtaaaaaagtt

SEQ ID NO: 823 - DNA, 16 bp, Artificial Sequence
  Synthetic oligonucleotide
ggcttggtaaaaaagt

SEQ ID NO: 824 - DNA, 16 bp, Artificial Sequence
  Synthetic oligonucleotide
gggcttggtaaaaaag

SEQ ID NO: 825 - DNA, 16 bp, Artificial Sequence
  Synthetic oligonucleotide
acttgatcccaggttc

SEQ ID NO: 826 - DNA, 16 bp, Artificial Sequence
  Synthetic oligonucleotide
cggccacttgatccca

SEQ ID NO: 827 - DNA, 16 bp, Artificial Sequence
  Synthetic oligonucleotide
tcggccacttgatccc

SEQ ID NO: 828 - DNA, 16 bp, Artificial Sequence
  Synthetic oligonucleotide
ctcggccacttgatcc

SEQ ID NO: 829 - DNA, 16 bp, Artificial Sequence
  Synthetic oligonucleotide
cctcggccacttgatc

SEQ ID NO: 830 - DNA, 16 bp, Artificial Sequence
  Synthetic oligonucleotide
acctcggccacttgat

SEQ ID NO: 831 - DNA, 16 bp, Artificial Sequence
  Synthetic oligonucleotide
gacctcggccacttga

SEQ ID NO: 832 - DNA, 16 bp, Artificial Sequence
  Synthetic oligonucleotide
ggacctcggccacttg

SEQ ID NO: 833 - DNA, 16 bp, Artificial Sequence
  Synthetic oligonucleotide
aggacctcggccactt

SEQ ID NO: 834 - DNA, 16 bp, Artificial Sequence
  Synthetic oligonucleotide
caggacctcggccact

SEQ ID NO: 835 - DNA, 16 bp, Artificial Sequence
  Synthetic oligonucleotide
agctcaggacctcggc

SEQ ID NO: 836 - DNA, 16 bp, Artificial Sequence
  Synthetic oligonucleotide
cagctcaggacctcgg

SEQ ID NO: 837 - DNA, 16 bp, Artificial Sequence
  Synthetic oligonucleotide
ccagctcaggacctcg

SEQ ID NO: 838 - DNA, 16 bp, Artificial Sequence
  Synthetic oligonucleotide
cgcttggtggtggagg

SEQ ID NO: 839 - DNA, 16 bp, Artificial Sequence
  Synthetic oligonucleotide
tcgcttggtggtggag

SEQ ID NO: 840 - DNA, 16 bp, Artificial Sequence
  Synthetic oligonucleotide
cctcgcttggtggtgg

SEQ ID NO: 841 - DNA, 16 bp, Artificial Sequence
  Synthetic oligonucleotide
tcctcgcttggtggtg

SEQ ID NO: 842 - DNA, 16 bp, Artificial Sequence
  Synthetic oligonucleotide
gtcctcgcttggtggt

SEQ ID NO: 843 - DNA, 16 bp, Artificial Sequence
  Synthetic oligonucleotide
agtcctcgcttggtgg

SEQ ID NO: 844 - DNA, 16 bp, Artificial Sequence
  Synthetic oligonucleotide
cagtcctcgcttggtg

SEQ ID NO: 845 - DNA, 16 bp, Artificial Sequence
  Synthetic oligonucleotide
tcagtcctcgcttggt

SEQ ID NO: 846 - DNA, 16 bp, Artificial Sequence
  Synthetic oligonucleotide
ctcagtcctcgcttgg

SEQ ID NO: 847 - DNA, 16 bp, Artificial Sequence
  Synthetic oligonucleotide
gctcagtcctcgcttg

SEQ ID NO: 848 - DNA, 16 bp, Artificial Sequence
  Synthetic oligonucleotide
tgctcagtcctcgctt

SEQ ID NO: 849 - DNA, 16 bp, Artificial Sequence
  Synthetic oligonucleotide
gatgctcagtcctcgc

SEQ ID NO: 850 - DNA, 16 bp, Artificial Sequence
  Synthetic oligonucleotide
cgatgctcagtcctcg

SEQ ID NO: 851 - DNA, 16 bp, Artificial Sequence
  Synthetic oligonucleotide
tcgatgctcagtcctc

SEQ ID NO: 852 - DNA, 16 bp, Artificial Sequence
  Synthetic oligonucleotide
ctcgatgctcagtcct

SEQ ID NO: 853 - DNA, 16 bp, Artificial Sequence
  Synthetic oligonucleotide
tgctcgatgctcagtc

SEQ ID NO: 854 - DNA, 16 bp, Artificial Sequence
  Synthetic oligonucleotide
ctgctcgatgctcagt

SEQ ID NO: 855 - DNA, 16 bp, Artificial Sequence
  Synthetic oligonucleotide
agctgctcgatgctca

SEQ ID NO: 856 - DNA, 16 bp, Artificial Sequence
  Synthetic oligonucleotide
cagctgctcgatgctc

SEQ ID NO: 857 - DNA, 16 bp, Artificial Sequence
  Synthetic oligonucleotide
gtcagctgctcgatgc

SEQ ID NO: 858 - DNA, 16 bp, Artificial Sequence
  Synthetic oligonucleotide
agtcagctgctcgatg

SEQ ID NO: 859 - DNA, 16 bp, Artificial Sequence
  Synthetic oligonucleotide
tagtcagctgctcgat

SEQ ID NO: 860 - DNA, 16 bp, Artificial Sequence
  Synthetic oligonucleotide
gtagtcagctgctcga

SEQ ID NO: 861 - DNA, 16 bp, Artificial Sequence
  Synthetic oligonucleotide
tgtagtcagctgctcg

SEQ ID NO: 862 - DNA, 16 bp, Artificial Sequence
  Synthetic oligonucleotide
gtgtagtcagctgctc

SEQ ID NO: 863 - DNA, 16 bp, Artificial Sequence
  Synthetic oligonucleotide
agtgtagtcagctgct

SEQ ID NO: 864 - DNA, 16 bp, Artificial Sequence
  Synthetic oligonucleotide
cagtgtagtcagctgc

SEQ ID NO: 865 - DNA, 16 bp, Artificial Sequence
  Synthetic oligonucleotide
ccagtgtagtcagctg

SEQ ID NO: 866 - DNA, 16 bp, Artificial Sequence
  Synthetic oligonucleotide
gccagtgtagtcagct

SEQ ID NO: 867 - DNA, 16 bp, Artificial Sequence
  Synthetic oligonucleotide
ccaggtcccaagagtt

SEQ ID NO: 868 - DNA, 16 bp, Artificial Sequence
  Synthetic oligonucleotide
gacaccctgaataatt

SEQ ID NO: 869 - DNA, 16 bp, Artificial Sequence
  Synthetic oligonucleotide
tgacaccctgaataat

SEQ ID NO: 870 - DNA, 16 bp, Artificial Sequence
  Synthetic oligonucleotide
atctgacaccctgaat

SEQ ID NO: 871 - DNA, 16 bp, Artificial Sequence
  Synthetic oligonucleotide
gatctgacaccctgaa

SEQ ID NO: 872 - DNA, 16 bp, Artificial Sequence
  Synthetic oligonucleotide
gtgatctgacaccctg

SEQ ID NO: 873 - DNA, 16 bp, Artificial Sequence
  Synthetic oligonucleotide
atgtgatctgacaccc

SEQ ID NO: 874 - DNA, 16 bp, Artificial Sequence
  Synthetic oligonucleotide
gcccatgtgatctgac

SEQ ID NO: 875 - DNA, 16 bp, Artificial Sequence
  Synthetic oligonucleotide
tagcccatgtgatctg

SEQ ID NO: 876 - DNA, 16 bp, Artificial Sequence
  Synthetic oligonucleotide
tttagcccatgtgatc

SEQ ID NO: 877 - DNA, 16 bp, Artificial Sequence
  Synthetic oligonucleotide
aaggagaagcccttgc

SEQ ID NO: 878 - DNA, 16 bp, Artificial Sequence
  Synthetic oligonucleotide
ttgtccagccagaccc

SEQ ID NO: 879 - DNA, 16 bp, Artificial Sequence
  Synthetic oligonucleotide
attgtccagccagacc

SEQ ID NO: 880 - DNA, 16 bp, Artificial Sequence
  Synthetic oligonucleotide
tattgtccagccagac

SEQ ID NO: 881 - DNA, 16 bp, Artificial Sequence
  Synthetic oligonucleotide
atattgtccagccaga

SEQ ID NO: 882 - DNA, 16 bp, Artificial Sequence
  Synthetic oligonucleotide
gatattgtccagccag

SEQ ID NO: 883 - DNA, 16 bp, Artificial Sequence
  Synthetic oligonucleotide
atgatattgtccagcc

SEQ ID NO: 884 - DNA, 16 bp, Artificial Sequence
  Synthetic oligonucleotide
caatgatattgtccag

SEQ ID NO: 885 - DNA, 16 bp, Artificial Sequence
  Synthetic oligonucleotide
gtcaatgatattgtcc

SEQ ID NO: 886 - DNA, 16 bp, Artificial Sequence
  Synthetic oligonucleotide
ggtcaatgatattgtc

SEQ ID NO: 887 - DNA, 16 bp, Artificial Sequence
  Synthetic oligonucleotide
cacaaggtcaatgata

SEQ ID NO: 888 - DNA, 16 bp, Artificial Sequence
  Synthetic oligonucleotide
tcacaaggtcaatgat

SEQ ID NO: 889 - DNA, 16 bp, Artificial Sequence
  Synthetic oligonucleotide
gtactttttcacaagg

SEQ ID NO: 890 - DNA, 16 bp, Artificial Sequence
  Synthetic oligonucleotide
ggatgtactttttcac

SEQ ID NO: 891 - DNA, 16 bp, Artificial Sequence
  Synthetic oligonucleotide
gccaggatgtactttt

SEQ ID NO: 892 - DNA, 16 bp, Artificial Sequence
  Synthetic oligonucleotide
aagggccaggatgtac

SEQ ID NO: 893 - DNA, 16 bp, Artificial Sequence
  Synthetic oligonucleotide
aaagggccaggatgta

SEQ ID NO: 894 - DNA, 16 bp, Artificial Sequence
  Synthetic oligonucleotide
ccgctccttactgata

SEQ ID NO: 895 - DNA, 16 bp, Artificial Sequence
  Synthetic oligonucleotide
ccgctcccgctcctta

SEQ ID NO: 896 - DNA, 16 bp, Artificial Sequence
  Synthetic oligonucleotide
tggcccgctcccgctc

SEQ ID NO: 897 - DNA, 16 bp, Artificial Sequence
  Synthetic oligonucleotide
atggcccgctcccgct

SEQ ID NO: 898 - DNA, 16 bp, Artificial Sequence
  Synthetic oligonucleotide
agatggcccgctcccg

SEQ ID NO: 899 - DNA, 16 bp, Artificial Sequence
  Synthetic oligonucleotide
aagatggcccgctccc

SEQ ID NO: 900 - DNA, 16 bp, Artificial Sequence
  Synthetic oligonucleotide
caagatggcccgctcc

SEQ ID NO: 901 - DNA, 16 bp, Artificial Sequence
  Synthetic oligonucleotide
tcaagatggcccgctc

SEQ ID NO: 902 - DNA, 16 bp, Artificial Sequence
  Synthetic oligonucleotide
gctcaagatggcccgc

SEQ ID NO: 903 - DNA, 16 bp, Artificial Sequence
  Synthetic oligonucleotide
tgctcaagatggcccg

SEQ ID NO: 904 - DNA, 16 bp, Artificial Sequence
  Synthetic oligonucleotide
gtgctcaagatggccc

SEQ ID NO: 905 - DNA, 16 bp, Artificial Sequence
  Synthetic oligonucleotide
aggtgcctggaggctt

SEQ ID NO: 906 - DNA, 16 bp, Artificial Sequence
  Synthetic oligonucleotide
ccaagtgaaagtgacg

SEQ ID NO: 907 - DNA, 16 bp, Artificial Sequence
  Synthetic oligonucleotide
cccaagtgaaagtgac

SEQ ID NO: 908 - DNA, 16 bp, Artificial Sequence
  Synthetic oligonucleotide
ggatctgggtcttacc

SEQ ID NO: 909 - DNA, 16 bp, Artificial Sequence
  Synthetic oligonucleotide
tggatctgggtcttac

SEQ ID NO: 910 - DNA, 16 bp, Artificial Sequence
  Synthetic oligonucleotide
ggactggatctgggtc

SEQ ID NO: 911 - DNA, 16 bp, Artificial Sequence
  Synthetic oligonucleotide
tccacggactggatct

SEQ ID NO: 912 - DNA, 16 bp, Artificial Sequence
  Synthetic oligonucleotide
ttccacggactggatc

SEQ ID NO: 913 - DNA, 16 bp, Artificial Sequence
  Synthetic oligonucleotide
gttccacggactggat

SEQ ID NO: 914 - DNA, 16 bp, Artificial Sequence
  Synthetic oligonucleotide
ggttccacggactgga

SEQ ID NO: 915 - DNA, 16 bp, Artificial Sequence
  Synthetic oligonucleotide
tggttccacggactgg

SEQ ID NO: 916 - DNA, 16 bp, Artificial Sequence
  Synthetic oligonucleotide
atggttccacggactg

SEQ ID NO: 917 - DNA, 16 bp, Artificial Sequence
  Synthetic oligonucleotide
tatggttccacggact

SEQ ID NO: 918 - DNA, 16 bp, Artificial Sequence
  Synthetic oligonucleotide
tgtatggttccacgga

SEQ ID NO: 919 - DNA, 16 bp, Artificial Sequence
  Synthetic oligonucleotide
gtgtatggttccacgg

SEQ ID NO: 920 - DNA, 16 bp, Artificial Sequence
  Synthetic oligonucleotide
gcccatgatgatttca

SEQ ID NO: 921 - DNA, 16 bp, Artificial Sequence
  Synthetic oligonucleotide
agcccatgatgatttc

SEQ ID NO: 922 - DNA, 16 bp, Artificial Sequence
  Synthetic oligonucleotide
tagcccatgatgattt

SEQ ID NO: 923 - DNA, 16 bp, Artificial Sequence
  Synthetic oligonucleotide
atagcccatgatgatt

SEQ ID NO: 924 - DNA, 16 bp, Artificial Sequence
  Synthetic oligonucleotide
tatagcccatgatgat

SEQ ID NO: 925 - DNA, 16 bp, Artificial Sequence
  Synthetic oligonucleotide
ttatagcccatgatga

SEQ ID NO: 926 - DNA, 16 bp, Artificial Sequence
  Synthetic oligonucleotide
cttatagcccatgatg

SEQ ID NO: 927 - DNA, 16 bp, Artificial Sequence
  Synthetic oligonucleotide
tcttatagcccatgat

SEQ ID NO: 928 - DNA, 16 bp, Artificial Sequence
  Synthetic oligonucleotide
atcttatagcccatga

SEQ ID NO: 929 - DNA, 16 bp, Artificial Sequence
  Synthetic oligonucleotide
gatcttatagcccatg

SEQ ID NO: 930 - DNA, 16 bp, Artificial Sequence
  Synthetic oligonucleotide
tgatcttatagcccat

SEQ ID NO: 931 - DNA, 16 bp, Artificial Sequence
  Synthetic oligonucleotide
atgatcttatagccca

SEQ ID NO: 932 - DNA, 16 bp, Artificial Sequence
  Synthetic oligonucleotide
catgatcttatagccc

SEQ ID NO: 933 - DNA, 16 bp, Artificial Sequence
  Synthetic oligonucleotide
tccatgatcttatagc

SEQ ID NO: 934 - DNA, 16 bp, Artificial Sequence
  Synthetic oligonucleotide
atccatgatcttatag

SEQ ID NO: 935 - DNA, 16 bp, Artificial Sequence
  Synthetic oligonucleotide
gtagcatccatgatct

SEQ ID NO: 936 - DNA, 16 bp, Artificial Sequence
  Synthetic oligonucleotide
ggtagcatccatgatc

SEQ ID NO: 937 - DNA, 16 bp, Artificial Sequence
  Synthetic oligonucleotide
attggtagcatccatg

SEQ ID NO: 938 - DNA, 16 bp, Artificial Sequence
  Synthetic oligonucleotide
tattggtagcatccat

SEQ ID NO: 939 - DNA, 16 bp, Artificial Sequence
  Synthetic oligonucleotide
atattggtagcatcca

SEQ ID NO: 940 - DNA, 16 bp, Artificial Sequence
  Synthetic oligonucleotide
tccttgggaatgtcag

SEQ ID NO: 941 - DNA, 16 bp, Artificial Sequence
  Synthetic oligonucleotide
tccgaatgcctcctcc

SEQ ID NO: 942 - DNA, 16 bp, Artificial Sequence
  Synthetic oligonucleotide
ttccgaatgcctcctc

SEQ ID NO: 943 - DNA, 16 bp, Artificial Sequence
  Synthetic oligonucleotide
tttccgaatgcctcct

SEQ ID NO: 944 - DNA, 16 bp, Artificial Sequence
  Synthetic oligonucleotide
ctttccgaatgcctcc

SEQ ID NO: 945 - DNA, 16 bp, Artificial Sequence
  Synthetic oligonucleotide
actttccgaatgcctc

SEQ ID NO: 946 - DNA, 16 bp, Artificial Sequence
  Synthetic oligonucleotide
atactttccgaatgcc

SEQ ID NO: 947 - DNA, 16 bp, Artificial Sequence
  Synthetic oligonucleotide
caatactttccgaatg

SEQ ID NO: 948 - DNA, 16 bp, Artificial Sequence
  Synthetic oligonucleotide
acaatactttccgaat

SEQ ID NO: 949 - DNA, 16 bp, Artificial Sequence
  Synthetic oligonucleotide
cgacaatactttccga

SEQ ID NO: 950 - DNA, 16 bp, Artificial Sequence
  Synthetic oligonucleotide
ccgacaatactttccg

SEQ ID NO: 951 - DNA, 16 bp, Artificial Sequence
  Synthetic oligonucleotide
gccgacaatactttcc

SEQ ID NO: 952 - DNA, 16 bp, Artificial Sequence
  Synthetic oligonucleotide
ggccgacaatactttc

SEQ ID NO: 953 - DNA, 16 bp, Artificial Sequence
  Synthetic oligonucleotide
ctggccgacaatactt

SEQ ID NO: 954 - DNA, 16 bp, Artificial Sequence
  Synthetic oligonucleotide
tctggccgacaatact

SEQ ID NO: 955 - DNA, 16 bp, Artificial Sequence
  Synthetic oligonucleotide
ctctggccgacaatac

SEQ ID NO: 956 - DNA, 16 bp, Artificial Sequence
  Synthetic oligonucleotide
ctctctggccgacaat

SEQ ID NO: 957 - DNA, 16 bp, Artificial Sequence
  Synthetic oligonucleotide
gctctctggccgacaa

SEQ ID NO: 958 - DNA, 16 bp, Artificial Sequence
  Synthetic oligonucleotide
ggctctctggccgaca

SEQ ID NO: 959 - DNA, 16 bp, Artificial Sequence
  Synthetic oligonucleotide
tggctctctggccgac

SEQ ID NO: 960 - DNA, 16 bp, Artificial Sequence
  Synthetic oligonucleotide
ctggctctctggccga

SEQ ID NO: 961 - DNA, 16 bp, Artificial Sequence
  Synthetic oligonucleotide
tacctgggtcagcttc

SEQ ID NO: 962 - DNA, 16 bp, Artificial Sequence
  Synthetic oligonucleotide
gctacctgggtcagct

SEQ ID NO: 963 - DNA, 16 bp, Artificial Sequence
  Synthetic oligonucleotide
cgctacctgggtcagc

SEQ ID NO: 964 - DNA, 16 bp, Artificial Sequence
  Synthetic oligonucleotide
gcgctacctgggtcag

SEQ ID NO: 965 - DNA, 16 bp, Artificial Sequence
  Synthetic oligonucleotide
ggtcttcaggtatggg

SEQ ID NO: 966 - DNA, 16 bp, Artificial Sequence
  Synthetic oligonucleotide
tggtcttcaggtatgg

SEQ ID NO: 967 - DNA, 16 bp, Artificial Sequence
  Synthetic oligonucleotide
cttggtcttcaggtat

SEQ ID NO: 968 - DNA, 16 bp, Artificial Sequence
  Synthetic oligonucleotide
gataaacttggtcttc

SEQ ID NO: 969 - DNA, 16 bp, Artificial Sequence
  Synthetic oligonucleotide
cagataaacttggtct

SEQ ID NO: 970 - DNA, 16 bp, Artificial Sequence
  Synthetic oligonucleotide
acagataaacttggtc

SEQ ID NO: 971 - DNA, 16 bp, Artificial Sequence
  Synthetic oligonucleotide
ggtgtcacacagataa

SEQ ID NO: 972 - DNA, 16 bp, Artificial Sequence
  Synthetic oligonucleotide
cgttggtgtcacacag

SEQ ID NO: 973 - DNA, 16 bp, Artificial Sequence
  Synthetic oligonucleotide
ggtattgctgcaggtc

SEQ ID NO: 974 - DNA, 16 bp, Artificial Sequence
  Synthetic oligonucleotide
tggtattgctgcaggt

SEQ ID NO: 975 - DNA, 16 bp, Artificial Sequence
  Synthetic oligonucleotide
atggtattgctgcagg

SEQ ID NO: 976 - DNA, 16 bp, Artificial Sequence
  Synthetic oligonucleotide
caatggtattgctgca

SEQ ID NO: 977 - DNA, 16 bp, Artificial Sequence
  Synthetic oligonucleotide
tcaatggtattgctgc

SEQ ID NO: 978 - DNA, 16 bp, Artificial Sequence
  Synthetic oligonucleotide
gtcaatggtattgctg

SEQ ID NO: 979 - DNA, 16 bp, Artificial Sequence
  Synthetic oligonucleotide
aggtcaatggtattgc

SEQ ID NO: 980 - DNA, 16 bp, Artificial Sequence
  Synthetic oligonucleotide
caggtcaatggtattg

SEQ ID NO: 981 - DNA, 16 bp, Artificial Sequence
  Synthetic oligonucleotide
gcaggtcaatggtatt

SEQ ID NO: 982 - DNA, 16 bp, Artificial Sequence
  Synthetic oligonucleotide
ggcaggtcaatggtat

SEQ ID NO: 983 - DNA, 16 bp, Artificial Sequence
  Synthetic oligonucleotide
cggcaggtcaatggta

SEQ ID NO: 984 - DNA, 16 bp, Artificial Sequence
  Synthetic oligonucleotide
tcggcaggtcaatggt

SEQ ID NO: 985 - DNA, 16 bp, Artificial Sequence
  Synthetic oligonucleotide
acatcggcaggtcaat

SEQ ID NO: 986 - DNA, 16 bp, Artificial Sequence
  Synthetic oligonucleotide
gacatcggcaggtcaa

SEQ ID NO: 987 - DNA, 16 bp, Artificial Sequence
  Synthetic oligonucleotide
ggacatcggcaggtca

SEQ ID NO: 988 - DNA, 16 bp, Artificial Sequence
  Synthetic oligonucleotide
gggacatcggcaggtc

SEQ ID NO: 989 - DNA, 16 bp, Artificial Sequence
  Synthetic oligonucleotide
tgaatctaaagtgcgg

SEQ ID NO: 990 - DNA, 16 bp, Artificial Sequence
  Synthetic oligonucleotide
caatgaatctaaagtg

SEQ ID NO: 991 - DNA, 16 bp, Artificial Sequence
  Synthetic oligonucleotide
ggttcagcaccttcac

SEQ ID NO: 992 - DNA, 16 bp, Artificial Sequence
  Synthetic oligonucleotide
gggttcagcaccttca

SEQ ID NO: 993 - DNA, 16 bp, Artificial Sequence
  Synthetic oligonucleotide
agggttcagcaccttc

SEQ ID NO: 994 - DNA, 16 bp, Artificial Sequence
  Synthetic oligonucleotide
gagggttcagcacctt

SEQ ID NO: 995 - DNA, 16 bp, Artificial Sequence
  Synthetic oligonucleotide
tgagggttcagcacct

SEQ ID NO: 996 - DNA, 16 bp, Artificial Sequence
  Synthetic oligonucleotide
gagggactcaaactgc

SEQ ID NO: 997 - DNA, 16 bp, Artificial Sequence
  Synthetic oligonucleotide
gtgagggactcaaact

SEQ ID NO: 998 - DNA, 16 bp, Artificial Sequence
  Synthetic oligonucleotide
ggtgagggactcaaac

SEQ ID NO: 999 - DNA, 16 bp, Artificial Sequence
  Synthetic oligonucleotide
aggtgagggactcaaa

SEQ ID NO: 1000 - DNA, 16 bp, Artificial Sequence
  Synthetic oligonucleotide
aaggtgagggactcaa

SEQ ID NO: 1001 - DNA, 16 bp, Artificial Sequence
  Synthetic oligonucleotide
caaaggtgagggactc

SEQ ID NO: 1002 - DNA, 16 bp, Artificial Sequence
  Synthetic oligonucleotide
tcaaaggtgagggact

SEQ ID NO: 1003 - DNA, 16 bp, Artificial Sequence
  Synthetic oligonucleotide
actccatgtcaaaggt

SEQ ID NO: 1004 - DNA, 16 bp, Artificial Sequence
  Synthetic oligonucleotide
gtcaactccatgtcaa

SEQ ID NO: 1005 - DNA, 16 bp, Artificial Sequence
  Synthetic oligonucleotide
ggtcaactccatgtca

SEQ ID NO: 1006 - DNA, 16 bp, Artificial Sequence
  Synthetic oligonucleotide
gaggtcaactccatgt

SEQ ID NO: 1007 - DNA, 16 bp, Artificial Sequence
  Synthetic oligonucleotide
cgaggtcaactccatg

SEQ ID NO: 1008 - DNA, 16 bp, Artificial Sequence
  Synthetic oligonucleotide
ccgaggtcaactccat

SEQ ID NO: 1009 - DNA, 16 bp, Artificial Sequence
  Synthetic oligonucleotide
ctccgaggtcaactcc

SEQ ID NO: 1010 - DNA, 16 bp, Artificial Sequence
  Synthetic oligonucleotide
actccgaggtcaactc

SEQ ID NO: 1011 - DNA, 16 bp, Artificial Sequence
  Synthetic oligonucleotide
cactccgaggtcaact

SEQ ID NO: 1012 - DNA, 16 bp, Artificial Sequence
  Synthetic oligonucleotide
cgttctcagctcctca

SEQ ID NO: 1013 - DNA, 16 bp, Artificial Sequence
  Synthetic oligonucleotide
ttccgttctcagctcc

SEQ ID NO: 1014 - DNA, 16 bp, Artificial Sequence
  Synthetic oligonucleotide
cttccgttctcagctc

SEQ ID NO: 1015 - DNA, 16 bp, Artificial Sequence
  Synthetic oligonucleotide
gcttccgttctcagct

SEQ ID NO: 1016 - DNA, 16 bp, Artificial Sequence
  Synthetic oligonucleotide
agcttccgttctcagc

SEQ ID NO: 1017 - DNA, 16 bp, Artificial Sequence
  Synthetic oligonucleotide
cagcttccgttctcag

SEQ ID NO: 1018 - DNA, 16 bp, Artificial Sequence
  Synthetic oligonucleotide
gcagcttccgttctca

SEQ ID NO: 1019 - DNA, 16 bp, Artificial Sequence
  Synthetic oligonucleotide
tttggctgtgtgaggg

SEQ ID NO: 1020 - DNA, 16 bp, Artificial Sequence
  Synthetic oligonucleotide
gtttggctgtgtgagg

SEQ ID NO: 1021 - DNA, 16 bp, Artificial Sequence
  Synthetic oligonucleotide
ggtttggctgtgtgag

SEQ ID NO: 1022 - DNA, 16 bp, Artificial Sequence
  Synthetic oligonucleotide
aagttagtagtttcag

SEQ ID NO: 1023 - DNA, 16 bp, Artificial Sequence
  Synthetic oligonucleotide
gcagaagtaggagatt

SEQ ID NO: 1024 - DNA, 16 bp, Artificial Sequence
  Synthetic oligonucleotide
ttgctcaaagatagca

SEQ ID NO: 1025 - DNA, 16 bp, Artificial Sequence
  Synthetic oligonucleotide
attgctcaaagatagc

SEQ ID NO: 1026 - DNA, 16 bp, Artificial Sequence
  Synthetic oligonucleotide
gattgctcaaagatag

SEQ ID NO: 1027 - DNA, 16 bp, Artificial Sequence
  Synthetic oligonucleotide
cagattgctcaaagat

SEQ ID NO: 1028 - DNA, 16 bp, Artificial Sequence
  Synthetic oligonucleotide
ccagattgctcaaaga

SEQ ID NO: 1029 - DNA, 16 bp, Artificial Sequence
  Synthetic oligonucleotide
gtgcccagattgctca

SEQ ID NO: 1030 - DNA, 16 bp, Artificial Sequence
  Synthetic oligonucleotide
gcagatcacccacatt

SEQ ID NO: 1031 - DNA, 16 bp, Artificial Sequence
  Synthetic oligonucleotide
taaaagcagatcaccc

SEQ ID NO: 1032 - DNA, 16 bp, Artificial Sequence
  Synthetic oligonucleotide
ctagccaccccccgcc

SEQ ID NO: 1033 - DNA, 16 bp, Artificial Sequence
  Synthetic oligonucleotide
tctagccaccccccgc

SEQ ID NO: 1034 - DNA, 16 bp, Artificial Sequence
  Synthetic oligonucleotide
ctctagccaccccccg

SEQ ID NO: 1035 - skipped

SEQ ID NO: 1036 - DNA, 16 bp, Artificial Sequence
  Synthetic oligonucleotide
aggaggcacttgtcta

SEQ ID NO: 1037 - DNA, 16 bp, Artificial Sequence
  Synthetic oligonucleotide
caggaggcacttgtct

SEQ ID NO: 1038 - DNA, 16 bp, Artificial Sequence
  Synthetic oligonucleotide
ccaggaggcacttgtc

SEQ ID NO: 1039 - DNA, 16 bp, Artificial Sequence
  Synthetic oligonucleotide
ggcagaaggatgccgc

SEQ ID NO: 1040 - DNA, 16 bp, Artificial Sequence
  Synthetic oligonucleotide
gcttacagaaacaggc

SEQ ID NO: 1041 - DNA, 16 bp, Artificial Sequence
  Synthetic oligonucleotide
caggagtatgtagcta

SEQ ID NO: 1042 - DNA, 16 bp, Artificial Sequence
  Synthetic oligonucleotide
ccaggagtatgtagct

SEQ ID NO: 1043 - DNA, 16 bp, Artificial Sequence
  Synthetic oligonucleotide
gccaggagtatgtagc

SEQ ID NO: 1044 - DNA, 16 bp, Artificial Sequence
  Synthetic oligonucleotide
tgccaggagtatgtag

SEQ ID NO: 1045 - DNA, 16 bp, Artificial Sequence
  Synthetic oligonucleotide
atgtcagcaaggttaa

SEQ ID NO: 1046 - DNA, 16 bp, Artificial Sequence
  Synthetic oligonucleotide
ggatgtcagcaaggtt

SEQ ID NO: 1047 - DNA, 16 bp, Artificial Sequence
  Synthetic oligonucleotide
ttggatgtcagcaagg

SEQ ID NO: 1048 - DNA, 16 bp, Artificial Sequence
  Synthetic oligonucleotide
gatagtcctatcttct

SEQ ID NO: 1049 - DNA, 16 bp, Artificial Sequence
  Synthetic oligonucleotide
acagtgttttttgccc

SEQ ID NO: 1050 - DNA, 16 bp, Artificial Sequence
  Synthetic oligonucleotide
agaaaggctatgctga

SEQ ID NO: 1051 - DNA, 16 bp, Artificial Sequence
  Synthetic oligonucleotide
gaggctgttaactgaa

SEQ ID NO: 1052 - DNA, 16 bp, Artificial Sequence
  Synthetic oligonucleotide
accaaggaggctgtta

SEQ ID NO: 1053 - DNA, 16 bp, Artificial Sequence
  Synthetic oligonucleotide
gctgaatgcttaaagc

SEQ ID NO: 1054 - DNA, 16 bp, Artificial Sequence
  Synthetic oligonucleotide
agattctctaccactt

SEQ ID NO: 1055 - DNA, 17 bp, Artificial Sequence
  Synthetic oligonucleotide
ggagattctctaccact

SEQ ID NO: 1056 - DNA, 16 bp, Artificial Sequence
  Synthetic oligonucleotide
gagattctctaccact

SEQ ID NO: 1057 - DNA, 16 bp, Artificial Sequence
  Synthetic oligonucleotide
atcttgcatgtctcct

SEQ ID NO: 1058 - DNA, 17 bp, Artificial Sequence
  Synthetic oligonucleotide
agatcttgcatgtctcc

SEQ ID NO: 1059 - DNA, 16 bp, Artificial Sequence
  Synthetic oligonucleotide
cccgccagctcactca

SEQ ID NO: 1060 - DNA, 16 bp, Artificial Sequence
  Synthetic oligonucleotide
ccccgccagctcactc

SEQ ID NO: 1061 - DNA, 16 bp, Artificial Sequence
  Synthetic oligonucleotide
aagccccgccagctca

SEQ ID NO: 1062 - DNA, 16 bp, Artificial Sequence
  Synthetic oligonucleotide
aaagccccgccagctc

SEQ ID NO: 1063 - DNA, 16 bp, Artificial Sequence
  Synthetic oligonucleotide
aaaagccccgccagct

SEQ ID NO: 1064 - DNA, 16 bp, Artificial Sequence
  Synthetic oligonucleotide
caaaagccccgccagc

SEQ ID NO: 1065 - DNA, 16 bp, Artificial Sequence
  Synthetic oligonucleotide
acaaaagccccgccag

SEQ ID NO: 1066 - DNA, 16 bp, Artificial Sequence
  Synthetic oligonucleotide
tgacaaaagccccgcc

SEQ ID NO: 1067 - DNA, 16 bp, Artificial Sequence
  Synthetic oligonucleotide
ctgacaaaagccccgc

SEQ ID NO: 1068 - DNA, 16 bp, Artificial Sequence
  Synthetic oligonucleotide
gctgacaaaagccccg

SEQ ID NO: 1069 - DNA, 16 bp, Artificial Sequence
  Synthetic oligonucleotide
cgctgacaaaagcccc

SEQ ID NO: 1070 - DNA, 16 bp, Artificial Sequence
  Synthetic oligonucleotide
tcgctgacaaaagccc

SEQ ID NO: 1071 - DNA, 16 bp, Artificial Sequence
  Synthetic oligonucleotide
atcgctgacaaaagcc

SEQ ID NO: 1072 - DNA, 16 bp, Artificial Sequence
  Synthetic oligonucleotide
catcgctgacaaaagc

SEQ ID NO: 1073 - DNA, 16 bp, Artificial Sequence
  Synthetic oligonucleotide
tccatcgctgacaaaa

SEQ ID NO: 1074 - DNA, 16 bp, Artificial Sequence
  Synthetic oligonucleotide
ctccatcgctgacaaa

SEQ ID NO: 1075 - DNA, 16 bp, Artificial Sequence
  Synthetic oligonucleotide
actccatcgctgacaa

SEQ ID NO: 1076 - DNA, 16 bp, Artificial Sequence
  Synthetic oligonucleotide
tactccatcgctgaca

SEQ ID NO: 1077 - DNA, 16 bp, Artificial Sequence
  Synthetic oligonucleotide
gtactccatcgctgac

SEQ ID NO: 1078 - DNA, 16 bp, Artificial Sequence
  Synthetic oligonucleotide
cgtactccatcgctga

SEQ ID NO: 1079 - DNA, 16 bp, Artificial Sequence
  Synthetic oligonucleotide
gagagttttctgcacg

SEQ ID NO: 1080 - DNA, 16 bp, Artificial Sequence
  Synthetic oligonucleotide
gtgagagttttctgca

SEQ ID NO: 1081 - DNA, 16 bp, Artificial Sequence
  Synthetic oligonucleotide
gtcagccagctcctcg

SEQ ID NO: 1082 - DNA, 16 bp, Artificial Sequence
  Synthetic oligonucleotide
cgcctcttccagtcag

SEQ ID NO: 1083 - DNA, 16 bp, Artificial Sequence
  Synthetic oligonucleotide
gccgcctcttccagtc

SEQ ID NO: 1084 - DNA, 16 bp, Artificial Sequence
  Synthetic oligonucleotide
tgccgcctcttccagt

SEQ ID NO: 1085 - DNA, 16 bp, Artificial Sequence
  Synthetic oligonucleotide
tctgttgccgcctctt

SEQ ID NO: 1086 - DNA, 16 bp, Artificial Sequence
  Synthetic oligonucleotide
atctgttgccgcctct

SEQ ID NO: 1087 - DNA, 16 bp, Artificial Sequence
  Synthetic oligonucleotide
aatctgttgccgcctc

SEQ ID NO: 1088 - DNA, 16 bp, Artificial Sequence
  Synthetic oligonucleotide
caatctgttgccgcct

SEQ ID NO: 1089 - DNA, 16 bp, Artificial Sequence
  Synthetic oligonucleotide
gcaatctgttgccgcc

SEQ ID NO: 1090 - DNA, 16 bp, Artificial Sequence
  Synthetic oligonucleotide
ggcaatctgttgccgc

SEQ ID NO: 1091 - DNA, 16 bp, Artificial Sequence
  Synthetic oligonucleotide
aggcaatctgttgccg

SEQ ID NO: 1092 - DNA, 16 bp, Artificial Sequence
  Synthetic oligonucleotide
caggcaatctgttgcc

SEQ ID NO: 1093 - DNA, 16 bp, Artificial Sequence
  Synthetic oligonucleotide
gcaggcaatctgttgc

SEQ ID NO: 1094 - DNA, 16 bp, Artificial Sequence
  Synthetic oligonucleotide
caatgcaggcaatctg

SEQ ID NO: 1095 - DNA, 16 bp, Artificial Sequence
  Synthetic oligonucleotide
ccaatgcaggcaatct

SEQ ID NO: 1096 - DNA, 16 bp, Artificial Sequence
  Synthetic oligonucleotide
tccaatgcaggcaatc

SEQ ID NO: 1097 - DNA, 16 bp, Artificial Sequence
  Synthetic oligonucleotide
ctccaatgcaggcaat

SEQ ID NO: 1098 - DNA, 16 bp, Artificial Sequence
  Synthetic oligonucleotide
cctccaatgcaggcaa

SEQ ID NO: 1099 - DNA, 16 bp, Artificial Sequence
  Synthetic oligonucleotide
ggcagatgttgggcgg

SEQ ID NO: 1100 - DNA, 16 bp, Artificial Sequence
  Synthetic oligonucleotide
aggcagatgttgggcg

SEQ ID NO: 1101 - DNA, 16 bp, Artificial Sequence
  Synthetic oligonucleotide
taggcagatgttgggc

SEQ ID NO: 1102 - DNA, 16 bp, Artificial Sequence
  Synthetic oligonucleotide
ctaggcagatgttggg

SEQ ID NO: 1103 - DNA, 16 bp, Artificial Sequence
  Synthetic oligonucleotide
tctaggcagatgttgg

SEQ ID NO: 1104 - DNA, 16 bp, Artificial Sequence
  Synthetic oligonucleotide
atctaggcagatgttg

SEQ ID NO: 1105 - DNA, 16 bp, Artificial Sequence
  Synthetic oligonucleotide
ccgatctaggcagatg

SEQ ID NO: 1106 - DNA, 16 bp, Artificial Sequence
  Synthetic oligonucleotide
agccgatctaggcaga

SEQ ID NO: 1107 - DNA, 16 bp, Artificial Sequence
  Synthetic oligonucleotide
tagccgatctaggcag

SEQ ID NO: 1108 - DNA, 16 bp, Artificial Sequence
  Synthetic oligonucleotide
ctagccgatctaggca

SEQ ID NO: 1109 - DNA, 16 bp, Artificial Sequence
  Synthetic oligonucleotide
tctagccgatctaggc

SEQ ID NO: 1110 - DNA, 16 bp, Artificial Sequence
  Synthetic oligonucleotide
ttctagccgatctagg

SEQ ID NO: 1111 - DNA, 16 bp, Artificial Sequence
  Synthetic oligonucleotide
tttctagccgatctag

SEQ ID NO: 1112 - DNA, 16 bp, Artificial Sequence
  Synthetic oligonucleotide
ttttctagccgatcta

SEQ ID NO: 1113 - DNA, 16 bp, Artificial Sequence
  Synthetic oligonucleotide
gttttctagccgatct

SEQ ID NO: 1114 - DNA, 16 bp, Artificial Sequence
  Synthetic oligonucleotide
cagttttctagccgat

SEQ ID NO: 1115 - DNA, 16 bp, Artificial Sequence
  Synthetic oligonucleotide
ccagttttctagccga

SEQ ID NO: 1116 - DNA, 16 bp, Artificial Sequence
  Synthetic oligonucleotide
tccagttttctagccg

SEQ ID NO: 1117 - DNA, 16 bp, Artificial Sequence
  Synthetic oligonucleotide
atccagttttctagcc

SEQ ID NO: 1118 - DNA, 16 bp, Artificial Sequence
  Synthetic oligonucleotide
cgttatccagttttct

SEQ ID NO: 1119 - DNA, 16 bp, Artificial Sequence
  Synthetic oligonucleotide
gattctgctaatgacg

SEQ ID NO: 1120 - DNA, 16 bp, Artificial Sequence
  Synthetic oligonucleotide
agattctgctaatgac

SEQ ID NO: 1121 - DNA, 16 bp, Artificial Sequence
  Synthetic oligonucleotide
gttgagattctgctaa

SEQ ID NO: 1122 - DNA, 16 bp, Artificial Sequence
  Synthetic oligonucleotide
agttgagattctgcta

SEQ ID NO: 1123 - DNA, 16 bp, Artificial Sequence
  Synthetic oligonucleotide
ggtctgaagttgagat

SEQ ID NO: 1124 - DNA, 16 bp, Artificial Sequence
  Synthetic oligonucleotide
cgggtctgaagttgag

SEQ ID NO: 1125 - DNA, 16 bp, Artificial Sequence
  Synthetic oligonucleotide
acgggtctgaagttga

SEQ ID NO: 1126 - DNA, 16 bp, Artificial Sequence
  Synthetic oligonucleotide
gacgggtctgaagttg

SEQ ID NO: 1127 - DNA, 16 bp, Artificial Sequence
  Synthetic oligonucleotide
tgacgggtctgaagtt

SEQ ID NO: 1128 - DNA, 16 bp, Artificial Sequence
  Synthetic oligonucleotide
ttgacgggtctgaagt

SEQ ID NO: 1129 - DNA, 16 bp, Artificial Sequence
  Synthetic oligonucleotide
gttgacgggtctgaag

SEQ ID NO: 1130 - DNA, 16 bp, Artificial Sequence
  Synthetic oligonucleotide
tgttgacgggtctgaa

SEQ ID NO: 1131 - DNA, 16 bp, Artificial Sequence
  Synthetic oligonucleotide
ttgttgacgggtctga

SEQ ID NO: 1132 - DNA, 16 bp, Artificial Sequence
  Synthetic oligonucleotide
tttgttgacgggtctg

SEQ ID NO: 1133 - DNA, 16 bp, Artificial Sequence
  Synthetic oligonucleotide
atttgttgacgggtct

SEQ ID NO: 1134 - DNA, 16 bp, Artificial Sequence
  Synthetic oligonucleotide
gcccttgccagccatg

SEQ ID NO: 1135 - DNA, 17 bp, Artificial Sequence
  Synthetic oligonucleotide
aagcccttgccagccat

SEQ ID NO: 1136 - DNA, 16 bp, Artificial Sequence
  Synthetic oligonucleotide
agcccttgccagccat

SEQ ID NO: 1137 - DNA, 16 bp, Artificial Sequence
  Synthetic oligonucleotide
tttttcacaaggtcaa

SEQ ID NO: 1138 - DNA, 17 bp, Artificial Sequence
  Synthetic oligonucleotide
actttttcacaaggtca

SEQ ID NO: 1139 - DNA, 16 bp, Artificial Sequence
  Synthetic oligonucleotide
ctttttcacaaggtca

SEQ ID NO: 1140 - DNA, 17 bp, Artificial Sequence
  Synthetic oligonucleotide
ccatgatcttatagccc

SEQ ID NO: 1141 - DNA, 16 bp, Artificial Sequence
  Synthetic oligonucleotide
tagcagaagtaggaga

SEQ ID NO: 1142 - DNA, 17 bp, Artificial Sequence
  Synthetic oligonucleotide
gatagcagaagtaggag

SEQ ID NO: 1143 - DNA, 16 bp, Artificial Sequence
  Synthetic oligonucleotide
atagcagaagtaggag

SEQ ID NO: 1144 - DNA, 16 bp, Artificial Sequence
  Synthetic oligonucleotide
tttggatgtcagcaag

SEQ ID NO: 1145 - DNA, 16 bp, Artificial Sequence
  Synthetic oligonucleotide
atttggatgtcagcaa

SEQ ID NO: 1146 - DNA, 17 bp, Artificial Sequence
  Synthetic oligonucleotide
ctatttggatgtcagca

SEQ ID NO: 1147 - DNA, 16 bp, Artificial Sequence
  Synthetic oligonucleotide
tatttggatgtcagca

SEQ ID NO: 1148 - DNA, 16 bp, Artificial Sequence
  Synthetic oligonucleotide
tctatttggatgtcag

SEQ ID NO: 1149 - DNA, 16 bp, Artificial Sequence
  Synthetic oligonucleotide
ttctatttggatgtca

SEQ ID NO: 1150 - DNA, 16 bp, Artificial Sequence
  Synthetic oligonucleotide
caccaaggaggctgtt

SEQ ID NO: 1151 - DNA, 17 bp, Artificial Sequence
  Synthetic oligonucleotide
agcaccaaggaggctgt

SEQ ID NO: 1152 - DNA, 16 bp, Artificial Sequence
  Synthetic oligonucleotide
gcaccaaggaggctgt

SEQ ID NO: 1153 - DNA, 16 bp, Artificial Sequence
  Synthetic oligonucleotide
ggtttgacctgaagcc

SEQ ID NO: 1154 - DNA, 16 bp, Artificial Sequence
  Synthetic oligonucleotide
gggtttgacctgaagc

SEQ ID NO: 1155 - DNA, 16 bp, Artificial Sequence
  Synthetic oligonucleotide
agggtttgacctgaag

SEQ ID NO: 1156 - DNA, 16 bp, Artificial Sequence
  Synthetic oligonucleotide
aagggtttgacctgaa

SEQ ID NO: 1157 - DNA, 16 bp, Artificial Sequence
  Synthetic oligonucleotide
taagggtttgacctga

SEQ ID NO: 1158 - DNA, 16 bp, Artificial Sequence
  Synthetic oligonucleotide
ttaagggtttgacctg

SEQ ID NO: 1159 - DNA, 16 bp, Artificial Sequence
  Synthetic oligonucleotide
gcagcttcagatgtct

SEQ ID NO: 1160 - DNA, 16 bp, Artificial Sequence
  Synthetic oligonucleotide
tgcagcttcagatgtc

SEQ ID NO: 1161 - DNA, 16 bp, Artificial Sequence
  Synthetic oligonucleotide
cttaaaccttcctatt

SEQ ID NO: 1162 - DNA, 16 bp, Artificial Sequence
  Synthetic oligonucleotide
ccttaaaccttcctat

SEQ ID NO: 1163 - DNA, 16 bp, Artificial Sequence
  Synthetic oligonucleotide
gattctccttaaacct

SEQ ID NO: 1164 - DNA, 16 bp, Artificial Sequence
  Synthetic oligonucleotide
agattctccttaaacc

SEQ ID NO: 1165 - DNA, 16 bp, Artificial Sequence
  Synthetic oligonucleotide
tagattctccttaaac

SEQ ID NO: 1166 - DNA, 16 bp, Artificial Sequence
  Synthetic oligonucleotide
ttagattctccttaaa

SEQ ID NO: 1167 - DNA, 16 bp, Artificial Sequence
  Synthetic oligonucleotide
gcttagattctcctta

SEQ ID NO: 1168 - DNA, 16 bp, Artificial Sequence
  Synthetic oligonucleotide
tgcttagattctcctt

SEQ ID NO: 1169 - DNA, 16 bp, Artificial Sequence
  Synthetic oligonucleotide
atgcttagattctcct

SEQ ID NO: 1170 - DNA, 17 bp, Artificial Sequence
  Synthetic oligonucleotide
aaatgcttagattctcc

SEQ ID NO: 1171 - DNA, 16 bp, Artificial Sequence
  Synthetic oligonucleotide
aatgcttagattctcc

SEQ ID NO: 1172 - DNA, 16 bp, Artificial Sequence
  Synthetic oligonucleotide
aaatgcttagattctc

SEQ ID NO: 1173 - DNA, 16 bp, Artificial Sequence
  Synthetic oligonucleotide
gtaagcaccctctgcc

SEQ ID NO: 1174 - DNA, 16 bp, Artificial Sequence
  Synthetic oligonucleotide
ttgtaagcaccctctg

SEQ ID NO: 1175 - DNA, 16 bp, Artificial Sequence
  Synthetic oligonucleotide
ggttgtaagcaccctc

SEQ ID NO: 1176 - DNA, 16 bp, Artificial Sequence
  Synthetic oligonucleotide
aggttgtaagcaccct

SEQ ID NO: 1177 - DNA, 16 bp, Artificial Sequence
  Synthetic oligonucleotide
aaggttgtaagcaccc

SEQ ID NO: 1178 - DNA, 16 bp, Artificial Sequence
  Synthetic oligonucleotide
tcaaggttgtaagcac

SEQ ID NO: 1179 - DNA, 16 bp, Artificial Sequence
  Synthetic oligonucleotide
gtcaaggttgtaagca

SEQ ID NO: 1180 - DNA, 16 bp, Artificial Sequence
  Synthetic oligonucleotide
agtcaaggttgtaagc

SEQ ID NO: 1181 - DNA, 16 bp, Artificial Sequence
  Synthetic oligonucleotide
ggagtcaaggttgtaa

SEQ ID NO: 1182 - DNA, 16 bp, Artificial Sequence
  Synthetic oligonucleotide
gggagtcaaggttgta

SEQ ID NO: 1183 - DNA, 16 bp, Artificial Sequence
  Synthetic oligonucleotide
gatcaagtccagggag

SEQ ID NO: 1184 - DNA, 17 bp, Artificial Sequence
  Synthetic oligonucleotide
cagatcaagtccaggga

SEQ ID NO: 1185 - DNA, 16 bp, Artificial Sequence
  Synthetic oligonucleotide
agatcaagtccaggga

SEQ ID NO: 1186 - DNA, 17 bp, Artificial Sequence
  Synthetic oligonucleotide
gcagatcaagtccaggg

SEQ ID NO: 1187 - DNA, 16 bp, Artificial Sequence
  Synthetic oligonucleotide
cagatcaagtccaggg

SEQ ID NO: 1188 - DNA, 16 bp, Artificial Sequence
  Synthetic oligonucleotide
gcagatcaagtccagg

SEQ ID NO: 1189 - DNA, 17 bp, Artificial Sequence
  Synthetic oligonucleotide
agcagatcaagtccagg

SEQ ID NO: 1190 - DNA, 16 bp, Artificial Sequence
  Synthetic oligonucleotide
agcagatcaagtccag

SEQ ID NO: 1191 - DNA, 16 bp, Artificial Sequence
  Synthetic oligonucleotide
acagcagatcaagtcc

SEQ ID NO: 1192 - DNA, 16 bp, Artificial Sequence
  Synthetic oligonucleotide
aacagcagatcaagtc

SEQ ID NO: 1193 - DNA, 16 bp, Artificial Sequence
  Synthetic oligonucleotide
acaacctagcctctga

SEQ ID NO: 1194 - DNA, 16 bp, Artificial Sequence
  Synthetic oligonucleotide
aacaacctagcctctg

SEQ ID NO: 1195 - DNA, 16 bp, Artificial Sequence
  Synthetic oligonucleotide
gaaacaacctagcctc

SEQ ID NO: 1196 - DNA, 16 bp, Artificial Sequence
  Synthetic oligonucleotide
agaaacaacctagcct

SEQ ID NO: 1197 - DNA, 16 bp, Artificial Sequence
  Synthetic oligonucleotide
cagaaacaacctagcc

SEQ ID NO: 1198 - DNA, 16 bp, Artificial Sequence
  Synthetic oligonucleotide
gataaggcacccacag

SEQ ID NO: 1199 - DNA, 16 bp, Artificial Sequence
  Synthetic oligonucleotide
tgataaggcacccaca

SEQ ID NO: 1200 - DNA, 16 bp, Artificial Sequence
  Synthetic oligonucleotide
ctgataaggcacccac

SEQ ID NO: 1201 - DNA, 16 bp, Artificial Sequence
  Synthetic oligonucleotide
ccctgataaggcaccc

SEQ ID NO: 1202 - DNA, 16 bp, Artificial Sequence
  Synthetic oligonucleotide
gccctgataaggcacc

SEQ ID NO: 1203 - DNA, 16 bp, Artificial Sequence
  Synthetic oligonucleotide
tcccagccctgataag

SEQ ID NO: 1204 - DNA, 16 bp, Artificial Sequence
  Synthetic oligonucleotide
tatcccagccctgata

SEQ ID NO: 1205 - DNA, 16 bp, Artificial Sequence
  Synthetic oligonucleotide
aagtatcccagccctg

SEQ ID NO: 1206 - DNA, 16 bp, Artificial Sequence
  Synthetic oligonucleotide
gaagtatcccagccct

SEQ ID NO: 1207 - DNA, 16 bp, Artificial Sequence
  Synthetic oligonucleotide
agaagtatcccagccc

SEQ ID NO: 1208 - DNA, 16 bp, Artificial Sequence
  Synthetic oligonucleotide
cagaagtatcccagcc

SEQ ID NO: 1209 - DNA, 16 bp, Artificial Sequence
  Synthetic oligonucleotide
tgagaccaggattcct

SEQ ID NO: 1210 - DNA, 16 bp, Artificial Sequence
  Synthetic oligonucleotide
gtcctgagaccaggat

SEQ ID NO: 1211 - DNA, 16 bp, Artificial Sequence
  Synthetic oligonucleotide
tgagctcaaccagaca

SEQ ID NO: 1212 - DNA, 16 bp, Artificial Sequence
  Synthetic oligonucleotide
ttccctgagctcaacc

SEQ ID NO: 1213 - DNA, 16 bp, Artificial Sequence
  Synthetic oligonucleotide
taagaaccatattccc

SEQ ID NO: 1214 - DNA, 16 bp, Artificial Sequence
  Synthetic oligonucleotide
taagcctttgccctgc

SEQ ID NO: 1215 - DNA, 16 bp, Artificial Sequence
  Synthetic oligonucleotide
gtaagcctttgccctg

SEQ ID NO: 1216 - DNA, 16 bp, Artificial Sequence
  Synthetic oligonucleotide
agtaagcctttgccct

SEQ ID NO: 1217 - DNA, 16 bp, Artificial Sequence
  Synthetic oligonucleotide
cagtaagcctttgccc

SEQ ID NO: 1218 - DNA, 16 bp, Artificial Sequence
  Synthetic oligonucleotide
atcagtaagcctttgc

SEQ ID NO: 1219 - DNA, 16 bp, Artificial Sequence
  Synthetic oligonucleotide
tatcagtaagcctttg

SEQ ID NO: 1220 - DNA, 16 bp, Artificial Sequence
  Synthetic oligonucleotide
agtttatcagtaagcc

SEQ ID NO: 1221 - DNA, 16 bp, Artificial Sequence
  Synthetic oligonucleotide
gactcaagtttatcag

SEQ ID NO: 1222 - DNA, 16 bp, Artificial Sequence
  Synthetic oligonucleotide
cagactcaagtttatc

SEQ ID NO: 1223 - DNA, 16 bp, Artificial Sequence
  Synthetic oligonucleotide
gcagactcaagtttat

SEQ ID NO: 1224 - DNA, 16 bp, Artificial Sequence
  Synthetic oligonucleotide
ggcagactcaagttta

SEQ ID NO: 1225 - DNA, 16 bp, Artificial Sequence
  Synthetic oligonucleotide
gggcagactcaagttt

SEQ ID NO: 1226 - DNA, 16 bp, Artificial Sequence
  Synthetic oligonucleotide
agggcagactcaagtt

SEQ ID NO: 1227 - DNA, 16 bp, Artificial Sequence
  Synthetic oligonucleotide
cgagggcagactcaag

SEQ ID NO: 1228 - DNA, 16 bp, Artificial Sequence
  Synthetic oligonucleotide
atacgagggcagactc

SEQ ID NO: 1229 - DNA, 16 bp, Artificial Sequence
  Synthetic oligonucleotide
catacgagggcagact

SEQ ID NO: 1230 - DNA, 16 bp, Artificial Sequence
  Synthetic oligonucleotide
tcatacgagggcagac

SEQ ID NO: 1231 - DNA, 16 bp, Artificial Sequence
  Synthetic oligonucleotide
cctcatacgagggcag

SEQ ID NO: 1232 - DNA, 16 bp, Artificial Sequence
  Synthetic oligonucleotide
ccctcatacgagggca

SEQ ID NO: 1233 - DNA, 16 bp, Artificial Sequence
  Synthetic oligonucleotide
tacgcacaggagaggc

SEQ ID NO: 1234 - DNA, 16 bp, Artificial Sequence
  Synthetic oligonucleotide
atacgcacaggagagg

SEQ ID NO: 1235 - DNA, 16 bp, Artificial Sequence
  Synthetic oligonucleotide
catacgcacaggagag

SEQ ID NO: 1236 - DNA, 16 bp, Artificial Sequence
  Synthetic oligonucleotide
ccatacgcacaggaga

SEQ ID NO: 1237 - DNA, 16 bp, Artificial Sequence
  Synthetic oligonucleotide
cccatacgcacaggag

SEQ ID NO: 1238 - DNA, 16 bp, Artificial Sequence
  Synthetic oligonucleotide
tcccatacgcacagga

SEQ ID NO: 1239 - DNA, 16 bp, Artificial Sequence
  Synthetic oligonucleotide
ttcccatacgcacagg

SEQ ID NO: 1240 - DNA, 16 bp, Artificial Sequence
  Synthetic oligonucleotide
gttcccatacgcacag

SEQ ID NO: 1241 - DNA, 16 bp, Artificial Sequence
  Synthetic oligonucleotide
tgttcccatacgcaca

SEQ ID NO: 1242 - DNA, 16 bp, Artificial Sequence
  Synthetic oligonucleotide
gtgttcccatacgcac

SEQ ID NO: 1243 - DNA, 16 bp, Artificial Sequence
  Synthetic oligonucleotide
ggtgttcccatacgca

SEQ ID NO: 1244 - DNA, 17 bp, Artificial Sequence
  Synthetic oligonucleotide
aggtgttcccatacgca

SEQ ID NO: 1245 - DNA, 16 bp, Artificial Sequence
  Synthetic oligonucleotide
aggtgttcccatacgc

SEQ ID NO: 1246 - DNA, 17 bp, Artificial Sequence
  Synthetic oligonucleotide
taggtgttcccatacgc

SEQ ID NO: 1247 - DNA, 16 bp, Artificial Sequence
  Synthetic oligonucleotide
ctaggtgttcccatac

SEQ ID NO: 1248 - DNA, 16 bp, Artificial Sequence
  Synthetic oligonucleotide
gctaggtgttcccata

SEQ ID NO: 1249 - DNA, 16 bp, Artificial Sequence
  Synthetic oligonucleotide
tgctaggtgttcccat

SEQ ID NO: 1250 - DNA, 16 bp, Artificial Sequence
  Synthetic oligonucleotide
cgtgctaggtgttccc

SEQ ID NO: 1251 - DNA, 16 bp, Artificial Sequence
  Synthetic oligonucleotide
caaggtggttttgagt

SEQ ID NO: 1252 - DNA, 16 bp, Artificial Sequence
  Synthetic oligonucleotide
ctctgatcagctgagg

SEQ ID NO: 1253 - DNA, 16 bp, Artificial Sequence
  Synthetic oligonucleotide
actctgatcagctgag

SEQ ID NO: 1254 - DNA, 16 bp, Artificial Sequence
  Synthetic oligonucleotide
gagaccagctaatttg

SEQ ID NO: 1255 - DNA, 16 bp, Artificial Sequence
  Synthetic oligonucleotide
catcttagagaaggtc

SEQ ID NO: 1256 - DNA, 16 bp, Artificial Sequence
  Synthetic oligonucleotide
tcaactgtctccaggc

SEQ ID NO: 1257 - DNA, 16 bp, Artificial Sequence
  Synthetic oligonucleotide
atcaactgtctccagg

SEQ ID NO: 1258 - DNA, 17 bp, Artificial Sequence
  Synthetic oligonucleotide
catcaactgtctccagg

SEQ ID NO: 1259 - DNA, 17 bp, Artificial Sequence
  Synthetic oligonucleotide
cacatcaactgtctcca

SEQ ID NO: 1260 - DNA, 16 bp, Artificial Sequence
  Synthetic oligonucleotide
acatcaactgtctcca

SEQ ID NO: 1261 - DNA, 16 bp, Artificial Sequence
  Synthetic oligonucleotide
gacacatcaactgtct

SEQ ID NO: 1262 - DNA, 16 bp, Artificial Sequence
  Synthetic oligonucleotide
gaagagtgttgctgga

SEQ ID NO: 1263 - DNA, 16 bp, Artificial Sequence
  Synthetic oligonucleotide
ctgaagagtgttgctg

SEQ ID NO: 1264 - DNA, 16 bp, Artificial Sequence
  Synthetic oligonucleotide
tactgaagagtgttgc

SEQ ID NO: 1265 - DNA, 16 bp, Artificial Sequence
  Synthetic oligonucleotide
attatgtactgaagag

SEQ ID NO: 1266 - DNA, 16 bp, Artificial Sequence
  Synthetic oligonucleotide
tattatgtactgaaga

SEQ ID NO: 1267 - DNA, 16 bp, Artificial Sequence
  Synthetic oligonucleotide
ttattatgtactgaag

SEQ ID NO: 1268 - DNA, 17 bp, Artificial Sequence
  Synthetic oligonucleotide
gcttattatgtactgaa

SEQ ID NO: 1269 - DNA, 16 bp, Artificial Sequence
  Synthetic oligonucleotide
cttattatgtactgaa

SEQ ID NO: 1270 - DNA, 16 bp, Artificial Sequence
  Synthetic oligonucleotide
agcttattatgtactg

SEQ ID NO: 1271 - DNA, 16 bp, Artificial Sequence
  Synthetic oligonucleotide
aagcttattatgtact

SEQ ID NO: 1272 - DNA, 16 bp, Artificial Sequence
  Synthetic oligonucleotide
taagcttattatgtac

SEQ ID NO: 1273 - DNA, 16 bp, Artificial Sequence
  Synthetic oligonucleotide
tatcagttaagcttat

SEQ ID NO: 1274 - DNA, 16 bp, Artificial Sequence
  Synthetic oligonucleotide
gtttatcagttaagct

SEQ ID NO: 1275 - DNA, 16 bp, Artificial Sequence
  Synthetic oligonucleotide
caatggtaagcccaag

SEQ ID NO: 1276 - DNA, 16 bp, Artificial Sequence
  Synthetic oligonucleotide
ccaatggtaagcccaa

SEQ ID NO: 1277 - DNA, 16 bp, Artificial Sequence
  Synthetic oligonucleotide
acccaatggtaagccc

SEQ ID NO: 1278 - DNA, 16 bp, Artificial Sequence
  Synthetic oligonucleotide
aaacccaatggtaagc

SEQ ID NO: 1279 - DNA, 16 bp, Artificial Sequence
  Synthetic oligonucleotide
taaacccaatggtaag

SEQ ID NO: 1280 - DNA, 16 bp, Artificial Sequence
  Synthetic oligonucleotide
ttaaacccaatggtaa

SEQ ID NO: 1281 - DNA, 16 bp, Artificial Sequence
  Synthetic oligonucleotide
tttaaacccaatggta

SEQ ID NO: 1282 - DNA, 16 bp, Artificial Sequence
  Synthetic oligonucleotide
cctatgatttaaaccc

SEQ ID NO: 1283 - DNA, 16 bp, Artificial Sequence
  Synthetic oligonucleotide
ggtccctatgatttaa

SEQ ID NO: 1284 - DNA, 16 bp, Artificial Sequence
  Synthetic oligonucleotide
aggtccctatgattta

SEQ ID NO: 1285 - DNA, 16 bp, Artificial Sequence
  Synthetic oligonucleotide
acctaaggccatgaac

SEQ ID NO: 1286 - DNA, 16 bp, Artificial Sequence
  Synthetic oligonucleotide
tacctaaggccatgaa

SEQ ID NO: 1287 - DNA, 16 bp, Artificial Sequence
  Synthetic oligonucleotide
ctacctaaggccatga

SEQ ID NO: 1288 - DNA, 16 bp, Artificial Sequence
  Synthetic oligonucleotide
gctacctaaggccatg

SEQ ID NO: 1289 - DNA, 16 bp, Artificial Sequence
  Synthetic oligonucleotide
tgctacctaaggccat

SEQ ID NO: 1290 - DNA, 16 bp, Artificial Sequence
  Synthetic oligonucleotide
atgctacctaaggcca

SEQ ID NO: 1291 - DNA, 16 bp, Artificial Sequence
  Synthetic oligonucleotide
catgctacctaaggcc

SEQ ID NO: 1292 - DNA, 16 bp, Artificial Sequence
  Synthetic oligonucleotide
acatgctacctaaggc

SEQ ID NO: 1293 - DNA, 16 bp, Artificial Sequence
  Synthetic oligonucleotide
gttaagaccagataca

SEQ ID NO: 1294 - DNA, 16 bp, Artificial Sequence
  Synthetic oligonucleotide
agttaagaccagatac

SEQ ID NO: 1295 - DNA, 16 bp, Artificial Sequence
  Synthetic oligonucleotide
gagttaagaccagata

SEQ ID NO: 1296 - DNA, 16 bp, Artificial Sequence
  Synthetic oligonucleotide
agagttaagaccagat

SEQ ID NO: 1297 - DNA, 16 bp, Artificial Sequence
  Synthetic oligonucleotide
caatcagagttaagac

SEQ ID NO: 1298 - DNA, 17 bp, Artificial Sequence
  Synthetic oligonucleotide
tacaatcagagttaaga

SEQ ID NO: 1299 - DNA, 16 bp, Artificial Sequence
  Synthetic oligonucleotide
acaatcagagttaaga

SEQ ID NO: 1300 - DNA, 16 bp, Artificial Sequence
  Synthetic oligonucleotide
gctacaatcagagtta

SEQ ID NO: 1301 - DNA, 16 bp, Artificial Sequence
  Synthetic oligonucleotide
tgctacaatcagagtt

SEQ ID NO: 1302 - DNA, 16 bp, Artificial Sequence
  Synthetic oligonucleotide
ttgctacaatcagagt

SEQ ID NO: 1303 - DNA, 16 bp, Artificial Sequence
  Synthetic oligonucleotide
ctctcagaacttttgc

SEQ ID NO: 1304 - DNA, 17 bp, Artificial Sequence
  Synthetic oligonucleotide
tcctctcagaacttttg

SEQ ID NO: 1305 - DNA, 16 bp, Artificial Sequence
  Synthetic oligonucleotide
cctctcagaacttttg

SEQ ID NO: 1306 - DNA, 16 bp, Artificial Sequence
  Synthetic oligonucleotide
cccacgggattccctc

SEQ ID NO: 1307 - DNA, 16 bp, Artificial Sequence
  Synthetic oligonucleotide
acccacgggattccct

SEQ ID NO: 1308 - DNA, 16 bp, Artificial Sequence
  Synthetic oligonucleotide
aacccacgggattccc

SEQ ID NO: 1309 - DNA, 16 bp, Artificial Sequence
  Synthetic oligonucleotide
caacccacgggattcc

SEQ ID NO: 1310 - DNA, 16 bp, Artificial Sequence
  Synthetic oligonucleotide
gcaacccacgggattc

SEQ ID NO: 1311 - DNA, 16 bp, Artificial Sequence
  Synthetic oligonucleotide
agcaacccacgggatt

SEQ ID NO: 1312 - DNA, 16 bp, Artificial Sequence
  Synthetic oligonucleotide
taagcaacccacggga

SEQ ID NO: 1313 - DNA, 16 bp, Artificial Sequence
  Synthetic oligonucleotide
gtaagcaacccacggg

SEQ ID NO: 1314 - DNA, 16 bp, Artificial Sequence
  Synthetic oligonucleotide
ggtaagcaacccacgg

SEQ ID NO: 1315 - DNA, 16 bp, Artificial Sequence
  Synthetic oligonucleotide
aggtaagcaacccacg

SEQ ID NO: 1316 - DNA, 16 bp, Artificial Sequence
  Synthetic oligonucleotide
taggtaagcaacccac

SEQ ID NO: 1317 - DNA, 17 bp, Artificial Sequence
  Synthetic oligonucleotide
gtaggtaagcaacccac

SEQ ID NO: 1318 - DNA, 16 bp, Artificial Sequence
  Synthetic oligonucleotide
aggtaggtaagcaacc

SEQ ID NO: 1319 - DNA, 16 bp, Artificial Sequence
  Synthetic oligonucleotide
ttataggtaggtaagc

SEQ ID NO: 1320 - DNA, 16 bp, Artificial Sequence
  Synthetic oligonucleotide
caccttataggtaggt

SEQ ID NO: 1321 - DNA, 16 bp, Artificial Sequence
  Synthetic oligonucleotide
accaccttataggtag

SEQ ID NO: 1322 - DNA, 16 bp, Artificial Sequence
  Synthetic oligonucleotide
taaaccaccttatagg

SEQ ID NO: 1323 - DNA, 16 bp, Artificial Sequence
  Synthetic oligonucleotide
ataaaccaccttatag

SEQ ID NO: 1324 - DNA, 16 bp, Artificial Sequence
  Synthetic oligonucleotide
ggacagcagcttataa

SEQ ID NO: 1325 - DNA, 16 bp, Artificial Sequence
  Synthetic oligonucleotide
aggacagcagcttata

SEQ ID NO: 1326 - DNA, 16 bp, Artificial Sequence
  Synthetic oligonucleotide
caggacagcagcttat

SEQ ID NO: 1327 - DNA, 17 bp, Artificial Sequence
  Synthetic oligonucleotide
ccaggacagcagcttat

SEQ ID NO: 1328 - DNA, 17 bp, Artificial Sequence
  Synthetic oligonucleotide
gccaggacagcagctta

SEQ ID NO: 1329 - DNA, 16 bp, Artificial Sequence
  Synthetic oligonucleotide
ccaggacagcagctta

SEQ ID NO: 1330 - DNA, 16 bp, Artificial Sequence
  Synthetic oligonucleotide
gccaggacagcagctt

SEQ ID NO: 1331 - DNA, 17 bp, Artificial Sequence
  Synthetic oligonucleotide
tggccaggacagcagct

SEQ ID NO: 1332 - DNA, 16 bp, Artificial Sequence
  Synthetic oligonucleotide
ggccaggacagcagct

SEQ ID NO: 1333 - DNA, 16 bp, Artificial Sequence
  Synthetic oligonucleotide
tggccaggacagcagc

SEQ ID NO: 1334 - DNA, 16 bp, Artificial Sequence
  Synthetic oligonucleotide
tttgaatgcagtggcc

SEQ ID NO: 1335 - DNA, 17 bp, Artificial Sequence
  Synthetic oligonucleotide
aatttgaatgcagtggc

SEQ ID NO: 1336 - DNA, 16 bp, Artificial Sequence
  Synthetic oligonucleotide
atttgaatgcagtggc

SEQ ID NO: 1337 - DNA, 17 bp, Artificial Sequence
  Synthetic oligonucleotide
gaatttgaatgcagtgg

SEQ ID NO: 1338 - DNA, 16 bp, Artificial Sequence
  Synthetic oligonucleotide
aatttgaatgcagtgg

SEQ ID NO: 1339 - DNA, 16 bp, Artificial Sequence
  Synthetic oligonucleotide
aagtacacattggaat

SEQ ID NO: 1340 - DNA, 17 bp, Artificial Sequence
  Synthetic oligonucleotide
tgaagtacacattggaa

SEQ ID NO: 1341 - DNA, 16 bp, Artificial Sequence
  Synthetic oligonucleotide
gaagtacacattggaa

SEQ ID NO: 1342 - DNA, 16 bp, Artificial Sequence
  Synthetic oligonucleotide
ttacactatgaagtac

SEQ ID NO: 1343 - DNA, 16 bp, Artificial Sequence
  Synthetic oligonucleotide
agttaaagtagataca

SEQ ID NO: 1344 - DNA, 16 bp, Artificial Sequence
  Synthetic oligonucleotide
cgtttatttctggaag

SEQ ID NO: 1345 - DNA, 16 bp, Artificial Sequence
  Synthetic oligonucleotide
cggttcctatataacg

SEQ ID NO: 1346 - DNA, 16 bp, Artificial Sequence
  Synthetic oligonucleotide
acggttcctatataac

SEQ ID NO: 1347 - DNA, 16 bp, Artificial Sequence
  Synthetic oligonucleotide
gtcatcccgaagagtc

SEQ ID NO: 1348 - DNA, 16 bp, Artificial Sequence
  Synthetic oligonucleotide
cccgagtcccttccga

SEQ ID NO: 1349 - DNA, 16 bp, Artificial Sequence
  Synthetic oligonucleotide
gcgccccgagtccctt

SEQ ID NO: 1350 - DNA, 16 bp, Artificial Sequence
  Synthetic oligonucleotide
cgaagaacgaaacttc

SEQ ID NO: 1351 - DNA, 16 bp, Artificial Sequence
  Synthetic oligonucleotide
tttctccgaagaacga

SEQ ID NO: 1352 - DNA, 16 bp, Artificial Sequence
  Synthetic oligonucleotide
cgagtgcgccctcgcc

SEQ ID NO: 1353 - DNA, 16 bp, Artificial Sequence
  Synthetic oligonucleotide
gtgacagtcgctccgg

SEQ ID NO: 1354 - DNA, 16 bp, Artificial Sequence
  Synthetic oligonucleotide
cgtgacagtcgctccg

SEQ ID NO: 1355 - DNA, 16 bp, Artificial Sequence
  Synthetic oligonucleotide
gcgctttccgaccccc

SEQ ID NO: 1356 - DNA, 16 bp, Artificial Sequence
  Synthetic oligonucleotide
gtaccggtctgtcaat

SEQ ID NO: 1357 - DNA, 16 bp, Artificial Sequence
  Synthetic oligonucleotide
aagagtaccggtctgt

SEQ ID NO: 1358 - DNA, 16 bp, Artificial Sequence
  Synthetic oligonucleotide
gaaagagtaccggtct

SEQ ID NO: 1359 - DNA, 16 bp, Artificial Sequence
  Synthetic oligonucleotide
ctggcttgacgggttg

SEQ ID NO: 1360 - DNA, 16 bp, Artificial Sequence
  Synthetic oligonucleotide
gctggcttgacgggtt

SEQ ID NO: 1361 - DNA, 16 bp, Artificial Sequence
  Synthetic oligonucleotide
ccgactttaccaggta

SEQ ID NO: 1362 - DNA, 16 bp, Artificial Sequence
  Synthetic oligonucleotide
ggccgactttaccagg

SEQ ID NO: 1363 - DNA, 16 bp, Artificial Sequence
  Synthetic oligonucleotide
ttctggccgactttac

SEQ ID NO: 1364 - DNA, 16 bp, Artificial Sequence
  Synthetic oligonucleotide
cgtcctatgcaattaa

SEQ ID NO: 1365 - DNA, 16 bp, Artificial Sequence
  Synthetic oligonucleotide
gttcattccgtcctat

SEQ ID NO: 1366 - DNA, 16 bp, Artificial Sequence
  Synthetic oligonucleotide
gacggtttgaatcttg

SEQ ID NO: 1367 - DNA, 16 bp, Artificial Sequence
  Synthetic oligonucleotide
ggcgacggtttgaatc

SEQ ID NO: 1368 - DNA, 16 bp, Artificial Sequence
  Synthetic oligonucleotide
ttgggcgacggtttga

SEQ ID NO: 1369 - DNA, 16 bp, Artificial Sequence
  Synthetic oligonucleotide
aacttgggcgacggtt

SEQ ID NO: 1370 - DNA, 16 bp, Artificial Sequence
  Synthetic oligonucleotide
cgacctgatatggcac

SEQ ID NO: 1371 - DNA, 16 bp, Artificial Sequence
  Synthetic oligonucleotide
aacgacctgatatggc

SEQ ID NO: 1372 - DNA, 16 bp, Artificial Sequence
  Synthetic oligonucleotide
acaacgacctgatatg

SEQ ID NO: 1373 - DNA, 16 bp, Artificial Sequence
  Synthetic oligonucleotide
atacagtaagaccagc

SEQ ID NO: 1374 - DNA, 17 bp, Artificial Sequence
  Synthetic oligonucleotide
acatacagtaagaccag

SEQ ID NO: 1375 - DNA, 16 bp, Artificial Sequence
  Synthetic oligonucleotide
catacagtaagaccag

SEQ ID NO: 1376 - DNA, 16 bp, Artificial Sequence
  Synthetic oligonucleotide
acatacagtaagacca

SEQ ID NO: 1377 - DNA, 16 bp, Artificial Sequence
  Synthetic oligonucleotide
aaaatttacaacccat

SEQ ID NO: 1378 - DNA, 17 bp, Artificial Sequence
  Synthetic oligonucleotide
caaaaatttacaaccca

SEQ ID NO: 1379 - DNA, 16 bp, Artificial Sequence
  Synthetic oligonucleotide
aaaaatttacaaccca

SEQ ID NO: 1380 - DNA, 16 bp, Artificial Sequence
  Synthetic oligonucleotide
caaaaatttacaaccc

SEQ ID NO: 1381 - DNA, 16 bp, Artificial Sequence
  Synthetic oligonucleotide
aatgctttatcagcac

SEQ ID NO: 1382 - DNA, 17 bp, Artificial Sequence
  Synthetic oligonucleotide
ccaatgctttatcagca

SEQ ID NO: 1383 - DNA, 16 bp, Artificial Sequence
  Synthetic oligonucleotide
caatgctttatcagca

SEQ ID NO: 1384 - DNA, 16 bp, Artificial Sequence
  Synthetic oligonucleotide
ccaatgctttatcagc

SEQ ID NO: 1385 - DNA, 16 bp, Artificial Sequence
  Synthetic oligonucleotide
actaaaatcaaggctc

SEQ ID NO: 1386 - DNA, 17 bp, Artificial Sequence
  Synthetic oligonucleotide
agactaaaatcaaggct

SEQ ID NO: 1387 - DNA, 16 bp, Artificial Sequence
  Synthetic oligonucleotide
gactaaaatcaaggct

SEQ ID NO: 1388 - DNA, 16 bp, Artificial Sequence
  Synthetic oligonucleotide
agactaaaatcaaggc

SEQ ID NO: 1389 - DNA, 16 bp, Artificial Sequence
  Synthetic oligonucleotide
aatggttctttgtgat

SEQ ID NO: 1390 - DNA, 17 bp, Artificial Sequence
  Synthetic oligonucleotide
ctaatggttctttgtga

SEQ ID NO: 1391 - DNA, 16 bp, Artificial Sequence
  Synthetic oligonucleotide
taatggttctttgtga

SEQ ID NO: 1392 - DNA, 16 bp, Artificial Sequence
  Synthetic oligonucleotide
ctgaaattccttggtc

SEQ ID NO: 1393 - DNA, 17 bp, Artificial Sequence
  Synthetic oligonucleotide
aactgaaattccttggt

SEQ ID NO: 1394 - DNA, 16 bp, Artificial Sequence
  Synthetic oligonucleotide
actgaaattccttggt

SEQ ID NO: 1395 - DNA, 16 bp, Artificial Sequence
  Synthetic oligonucleotide
aactgaaattccttgg

SEQ ID NO: 1396 - DNA, 16 bp, Artificial Sequence
  Synthetic oligonucleotide
actctttcagtggttt

SEQ ID NO: 1397 - DNA, 17 bp, Artificial Sequence
  Synthetic oligonucleotide
gtactctttcagtggtt

SEQ ID NO: 1398 - DNA, 16 bp, Artificial Sequence
  Synthetic oligonucleotide
tactctttcagtggtt

SEQ ID NO: 1399 - DNA, 16 bp, Artificial Sequence
  Synthetic oligonucleotide
gtactctttcagtggt

SEQ ID NO: 1400 - DNA, 16 bp, Artificial Sequence
  Synthetic oligonucleotide
ctacactttacgctta

SEQ ID NO: 1401 - DNA, 16 bp, Artificial Sequence
  Synthetic oligonucleotide
aattcattcttccata

SEQ ID NO: 1402 - DNA, 17 bp, Artificial Sequence
  Synthetic oligonucleotide
gaaattcattcttccat

SEQ ID NO: 1403 - DNA, 16 bp, Artificial Sequence
  Synthetic oligonucleotide
aaattcattcttccat

SEQ ID NO: 1404 - DNA, 16 bp, Artificial Sequence
  Synthetic oligonucleotide
ttaaagagttgcggta

SEQ ID NO: 1405 - DNA, 16 bp, Artificial Sequence
  Synthetic oligonucleotide
attaaagagttgcggt

SEQ ID NO: 1406 - DNA, 16 bp, Artificial Sequence
  Synthetic oligonucleotide
agatttaccttcctta

SEQ ID NO: 1407 - DNA, 17 bp, Artificial Sequence
  Synthetic oligonucleotide
gcagatttaccttcctt

SEQ ID NO: 1408 - DNA, 16 bp, Artificial Sequence
  Synthetic oligonucleotide
cagatttaccttcctt

SEQ ID NO: 1409 - DNA, 16 bp, Artificial Sequence
  Synthetic oligonucleotide
gcagatttaccttcct

SEQ ID NO: 1410 - DNA, 16 bp, Artificial Sequence
  Synthetic oligonucleotide
gcccctatgtataagc

SEQ ID NO: 1411 - DNA, 17 bp, Artificial Sequence
  Synthetic oligonucleotide
ctgcccctatgtataag

SEQ ID NO: 1412 - DNA, 16 bp, Artificial Sequence
  Synthetic oligonucleotide
tgcccctatgtataag

SEQ ID NO: 1413 - DNA, 16 bp, Artificial Sequence
  Synthetic oligonucleotide
ctgcccctatgtataa

SEQ ID NO: 1414 - DNA, 16 bp, Artificial Sequence
  Synthetic oligonucleotide
ttcttcctgagacaca

SEQ ID NO: 1415 - DNA, 17 bp, Artificial Sequence
  Synthetic oligonucleotide
gcttcttcctgagacac

SEQ ID NO: 1416 - DNA, 16 bp, Artificial Sequence
  Synthetic oligonucleotide
cttcttcctgagacac

SEQ ID NO: 1417 - DNA, 16 bp, Artificial Sequence
  Synthetic oligonucleotide
gcttcttcctgagaca

SEQ ID NO: 1418 - DNA, 17 bp, Artificial Sequence
  Synthetic oligonucleotide
tggcttcttcctgagac

SEQ ID NO: 1419 - DNA, 16 bp, Artificial Sequence
  Synthetic oligonucleotide
ggcttcttcctgagac

SEQ ID NO: 1420 - DNA, 16 bp, Artificial Sequence
  Synthetic oligonucleotide
tggcttcttcctgaga

SEQ ID NO: 1421 - DNA, 16 bp, Artificial Sequence
  Synthetic oligonucleotide
ctcctgttggcttctt

SEQ ID NO: 1422 - DNA, 17 bp, Artificial Sequence
  Synthetic oligonucleotide
tcctcctgttggcttct

SEQ ID NO: 1423 - DNA, 16 bp, Artificial Sequence
  Synthetic oligonucleotide
cctcctgttggcttct

SEQ ID NO: 1424 - DNA, 17 bp, Artificial Sequence
  Synthetic oligonucleotide
ttcctcctgttggcttc

SEQ ID NO: 1425 - DNA, 16 bp, Artificial Sequence
  Synthetic oligonucleotide
tcctcctgttggcttc

SEQ ID NO: 1426 - DNA, 16 bp, Artificial Sequence
  Synthetic oligonucleotide
ttcctcctgttggctt

SEQ ID NO: 1427 - DNA, 17 bp, Artificial Sequence
  Synthetic oligonucleotide
ggttcctcctgttggct

SEQ ID NO: 1428 - DNA, 16 bp, Artificial Sequence
  Synthetic oligonucleotide
gttcctcctgttggct

SEQ ID NO: 1429 - DNA, 16 bp, Artificial Sequence
  Synthetic oligonucleotide
ggttcctcctgttggc

SEQ ID NO: 1430 - DNA, 16 bp, Artificial Sequence
  Synthetic oligonucleotide
gtaatgtgcagcaatc

SEQ ID NO: 1431 - DNA, 16 bp, Artificial Sequence
  Synthetic oligonucleotide
atgtgagggcacattt

SEQ ID NO: 1432 - DNA, 16 bp, Artificial Sequence
  Synthetic oligonucleotide
ccaagccgtttatttc

SEQ ID NO: 1433 - DNA, 16 bp, Artificial Sequence
  Synthetic oligonucleotide
ggaagccaagccgttt

SEQ ID NO: 1434 - DNA, 16 bp, Artificial Sequence
  Synthetic oligonucleotide
tacaattcctgcctgt

SEQ ID NO: 1435 - DNA, 16 bp, Artificial Sequence
  Synthetic oligonucleotide
agcttttctatgaaaa

SEQ ID NO: 1436 - DNA, 17 bp, Artificial Sequence
  Synthetic oligonucleotide
caagcttttctatgaaa

SEQ ID NO: 1437 - DNA, 16 bp, Artificial Sequence
  Synthetic oligonucleotide
aagcttttctatgaaa

SEQ ID NO: 1438 - DNA, 16 bp, Artificial Sequence
  Synthetic oligonucleotide
taattgtgtactggca

SEQ ID NO: 1439 - DNA, 17 bp, Artificial Sequence
  Synthetic oligonucleotide
tataattgtgtactggc

SEQ ID NO: 1440 - DNA, 16 bp, Artificial Sequence
  Synthetic oligonucleotide
ataattgtgtactggc

SEQ ID NO: 1441 - DNA, 16 bp, Artificial Sequence
  Synthetic oligonucleotide
tataattgtgtactgg

SEQ ID NO: 1442 - DNA, 16 bp, Artificial Sequence
  Synthetic oligonucleotide
tggagtaacaggaact

SEQ ID NO: 1443 - DNA, 16 bp, Artificial Sequence
  Synthetic oligonucleotide
aaagtttcccaataga

SEQ ID NO: 1444 - DNA, 16 bp, Artificial Sequence
  Synthetic oligonucleotide
agtcctaccacggccc

SEQ ID NO: 1445 - DNA, 16 bp, Artificial Sequence
  Synthetic oligonucleotide
tgacgatgcttggata

SEQ ID NO: 1446 - DNA, 16 bp, Artificial Sequence
  Synthetic oligonucleotide
ctgacgatgcttggat

SEQ ID NO: 1447 - DNA, 16 bp, Artificial Sequence
  Synthetic oligonucleotide
tcactttccctatacg

SEQ ID NO: 1448 - DNA, 16 bp, Artificial Sequence
  Synthetic oligonucleotide
gtaggttgagcaagca

SEQ ID NO: 1449 - DNA, 16 bp, Artificial Sequence
  Synthetic oligonucleotide
actttagccccttcca

SEQ ID NO: 1450 - DNA, 17 bp, Artificial Sequence
  Synthetic oligonucleotide
caactttagccccttcc

SEQ ID NO: 1451 - DNA, 16 bp, Artificial Sequence
  Synthetic oligonucleotide
aactttagccccttcc

SEQ ID NO: 1452 - DNA, 16 bp, Artificial Sequence
  Synthetic oligonucleotide
caactttagccccttc

SEQ ID NO: 1453 - DNA, 16 bp, Artificial Sequence
  Synthetic oligonucleotide
aattcatcgagctaat

SEQ ID NO: 1454 - DNA, 16 bp, Artificial Sequence
  Synthetic oligonucleotide
tgccccaattaggcca

SEQ ID NO: 1455 - DNA, 16 bp, Artificial Sequence
  Synthetic oligonucleotide
ttgccccaattaggcc

SEQ ID NO: 1456 - DNA, 16 bp, Artificial Sequence
  Synthetic oligonucleotide
ccctgtggctccttcc

SEQ ID NO: 1457 - DNA, 16 bp, Artificial Sequence
  Synthetic oligonucleotide
tactgtcctcgagaca

SEQ ID NO: 1458 - DNA, 16 bp, Artificial Sequence
  Synthetic oligonucleotide
aggaaaaggaagaatg

SEQ ID NO: 1459 - DNA, 16 bp, Artificial Sequence
  Synthetic oligonucleotide
cgcatatgccctagga

SEQ ID NO: 1460 - DNA, 16 bp, Artificial Sequence
  Synthetic oligonucleotide
gccgcatatgccctag

SEQ ID NO: 1461 - DNA, 16 bp, Artificial Sequence
  Synthetic oligonucleotide
ggccgcatatgcccta

SEQ ID NO: 1462 - DNA, 16 bp, Artificial Sequence
  Synthetic oligonucleotide
cgggtaagtatacaga

SEQ ID NO: 1463 - DNA, 16 bp, Artificial Sequence
  Synthetic oligonucleotide
cacgggtaagtataca

SEQ ID NO: 1464 - DNA, 16 bp, Artificial Sequence
  Synthetic oligonucleotide
tcacgggtaagtatac

SEQ ID NO: 1465 - DNA, 16 bp, Artificial Sequence
  Synthetic oligonucleotide
gctcacgggtaagtat

SEQ ID NO: 1466 - DNA, 16 bp, Artificial Sequence
  Synthetic oligonucleotide
gtatacaatggccttt

SEQ ID NO: 1467 - DNA, 16 bp, Artificial Sequence
  Synthetic oligonucleotide
cgacccaatcagatgc

SEQ ID NO: 1468 - DNA, 16 bp, Artificial Sequence
  Synthetic oligonucleotide
ggataaaatacaaagg

SEQ ID NO: 1469 - DNA, 16 bp, Artificial Sequence
  Synthetic oligonucleotide
gttccgaaaaaacctc

SEQ ID NO: 1470 - DNA, 16 bp, Artificial Sequence
  Synthetic oligonucleotide
gggttccgaaaaaacc

SEQ ID NO: 1471 - DNA, 16 bp, Artificial Sequence
  Synthetic oligonucleotide
tgcaaactttttctct

SEQ ID NO: 1472 - DNA, 16 bp, Artificial Sequence
  Synthetic oligonucleotide
acccgctatccactca

SEQ ID NO: 1473 - DNA, 16 bp, Artificial Sequence
  Synthetic oligonucleotide
cactttccattctagt

SEQ ID NO: 1474 - DNA, 17 bp, Artificial Sequence
  Synthetic oligonucleotide
cacactttccattctag

SEQ ID NO: 1475 - DNA, 16 bp, Artificial Sequence
  Synthetic oligonucleotide
acactttccattctag

SEQ ID NO: 1476 - DNA, 16 bp, Artificial Sequence
  Synthetic oligonucleotide
cacactttccattcta

SEQ ID NO: 1477 - DNA, 16 bp, Artificial Sequence
  Synthetic oligonucleotide
agcccctatggttacc

SEQ ID NO: 1478 - DNA, 16 bp, Artificial Sequence
  Synthetic oligonucleotide
gtctagaggcctatcc

SEQ ID NO: 1479 - DNA, 16 bp, Artificial Sequence
  Synthetic oligonucleotide
ggtctagaggcctatc

SEQ ID NO: 1480 - DNA, 16 bp, Artificial Sequence
  Synthetic oligonucleotide
agatgttggatgtcta

SEQ ID NO: 1481 - DNA, 16 bp, Artificial Sequence
  Synthetic oligonucleotide
ccgccttaagatctaa

SEQ ID NO: 1482 - DNA, 16 bp, Artificial Sequence
  Synthetic oligonucleotide
cccttactctccgcat

SEQ ID NO: 1483 - DNA, 16 bp, Artificial Sequence
  Synthetic oligonucleotide
gggaagtggtccgacc

SEQ ID NO: 1484 - DNA, 16 bp, Artificial Sequence
  Synthetic oligonucleotide
ccgcaagtgagcgaga

SEQ ID NO: 1485 - DNA, 16 bp, Artificial Sequence
  Synthetic oligonucleotide
atcccgcaagtgagcg

SEQ ID NO: 1486 - DNA, 16 bp, Artificial Sequence
  Synthetic oligonucleotide
gaaatcccgcaagtga

SEQ ID NO: 1487 - DNA, 16 bp, Artificial Sequence
  Synthetic oligonucleotide
tcaatctagctttcga

SEQ ID NO: 1488 - DNA, 16 bp, Artificial Sequence
  Synthetic oligonucleotide
ttcaatctagctttcg

SEQ ID NO: 1489 - DNA, 16 bp, Artificial Sequence
  Synthetic oligonucleotide
gtaccaattctgtggg

SEQ ID NO: 1490 - DNA, 16 bp, Artificial Sequence
  Synthetic oligonucleotide
gtaacacctcacccta

SEQ ID NO: 1491 - DNA, 16 bp, Artificial Sequence
  Synthetic oligonucleotide
tctgccacccaggttt

SEQ ID NO: 1492 - DNA, 16 bp, Artificial Sequence
  Synthetic oligonucleotide
taaatttccgggatct

SEQ ID NO: 1493 - DNA, 16 bp, Artificial Sequence
  Synthetic oligonucleotide
ccggtcccttgtaaaa

SEQ ID NO: 1494 - DNA, 16 bp, Artificial Sequence
  Synthetic oligonucleotide
gccaactctaggcgag

SEQ ID NO: 1495 - DNA, 16 bp, Artificial Sequence
  Synthetic oligonucleotide
cgcaagagatcccggg

SEQ ID NO: 1496 - DNA, 16 bp, Artificial Sequence
  Synthetic oligonucleotide
tcgcaagagatcccgg

SEQ ID NO: 1497 - DNA, 16 bp, Artificial Sequence
  Synthetic oligonucleotide
tgatcacctcgactga

SEQ ID NO: 1498 - DNA, 16 bp, Artificial Sequence
  Synthetic oligonucleotide
gccaccctagtgttga

SEQ ID NO: 1499 - DNA, 16 bp, Artificial Sequence
  Synthetic oligonucleotide
tttgcctatctatcct

SEQ ID NO: 1500 - DNA, 16 bp, Artificial Sequence
  Synthetic oligonucleotide
cggtcaccccaacaaa

SEQ ID NO: 1501 - DNA, 16 bp, Artificial Sequence
  Synthetic oligonucleotide
aagggcgatggtaatg

SEQ ID NO: 1502 - DNA, 16 bp, Artificial Sequence
  Synthetic oligonucleotide
gtacaattgcttcaac

SEQ ID NO: 1503 - DNA, 17 bp, Artificial Sequence
  Synthetic oligonucleotide
cagtacaattgcttcaa

SEQ ID NO: 1504 - DNA, 16 bp, Artificial Sequence
  Synthetic oligonucleotide
agtacaattgcttcaa

SEQ ID NO: 1505 - DNA, 16 bp, Artificial Sequence
  Synthetic oligonucleotide
cagtacaattgcttca

SEQ ID NO: 1506 - DNA, 16 bp, Artificial Sequence
  Synthetic oligonucleotide
ctcatgccaagattgt

SEQ ID NO: 1507 - DNA, 16 bp, Artificial Sequence
  Synthetic oligonucleotide
aagccacttacggtgt

SEQ ID NO: 1508 - DNA, 16 bp, Artificial Sequence
  Synthetic oligonucleotide
cgtctatttccagtgt

SEQ ID NO: 1509 - DNA, 16 bp, Artificial Sequence
  Synthetic oligonucleotide
actagttcagttgtcc

SEQ ID NO: 1510 - DNA, 17 bp, Artificial Sequence
  Synthetic oligonucleotide
tccttaaaccttcctat

SEQ ID NO: 1511 - DNA, 17 bp, Artificial Sequence
  Synthetic oligonucleotide
ttagattctccttaaac

SEQ ID NO: 1512 - DNA, 17 bp, Artificial Sequence
  Synthetic oligonucleotide
atgcttagattctcctt

SEQ ID NO: 1513 - DNA, 18 bp, Artificial Sequence
  Primer
cgacagcttccccatgga

SEQ ID NO: 1514 - DNA, 23 bp, Artificial Sequence
  Primer
atgcccagtcttgactctcaatc

SEQ ID NO: 1515 - DNA, 22 bp, Artificial Sequence
  Probe
ctgcggcagttcctggcacctt

SEQ ID NO: 1516 - DNA, 15 bp, Artificial Sequence
  Primer
tcgccgcttgctgca

SEQ ID NO: 1517 - DNA, 17 bp, Artificial Sequence
  Primer
atcggccgtgatgtcga

SEQ ID NO: 1518 - DNA, 23 bp, Artificial Sequence
  Probe
ccatggtcaaccccaccgtgttc

SEQ ID NO: 1519 - DNA, 20 bp, Artificial Sequence
  Synthetic oligonucleotide
tcttatgtttccgaaccgtt

SEQ ID NO: 1520 - DNA, 15 bp, Artificial Sequence
  Primer
gaggcccgcccaaca

SEQ ID NO: 1521 - DNA, 26 bp, Artificial Sequence
  Primer
ttctgctaatgacgttatccagtttt

SEQ ID NO: 1522 - DNA, 14 bp, Artificial Sequence
  Probe
ctgcctagatcggc

SEQ ID NO: 1523 - DNA, 19 bp, Artificial Sequence
  Primer
gaaggtgaaggtcggagtc

SEQ ID NO: 1524 - DNA, 20 bp, Artificial Sequence
  Primer
gaagatggtgatgggatttc

SEQ ID NO: 1525 - DNA, 20 bp, Artificial Sequence
  Probe
caagcttcccgttctcagcc

SEQ ID NO: 1526 - DNA, 16 bp, Artificial Sequence
  Primer
gacggcgagcccttgg

SEQ ID NO: 1527 - DNA, 21 bp, Artificial Sequence
  Primer
tgctgtctttgggaccttgtc

SEQ ID NO: 1528 - DNA, 24 bp, Artificial Sequence
  Probe
ccgcgtctcctttgagctgtttgc

SEQ ID NO: 1529 - DNA, 25 bp, Artificial Sequence
  Primer
cggactatgacttagttgcgttaca

SEQ ID NO: 1530 - DNA, 21 bp, Artificial Sequence
  Primer
gccatgccaatctcatcttgt

SEQ ID NO: 1531 - DNA, 30 bp, Artificial Sequence
  Probe
cctttcttgacaaaacctaacttgcgcaga

SEQ ID NO: 1532 - DNA, 25 bp, Artificial Sequence
  Primer
aagtttatctgtgtgacaccaacga

SEQ ID NO: 1533 - DNA, 25 bp, Artificial Sequence
  Primer
cttcaccattatttccaaactgcat

SEQ ID NO: 1534 - DNA, 18 bp, Artificial Sequence
  Probe
tgccgatgtccccccgca

SEQ ID NO: 1535 - DNA, 20 bp, Artificial Sequence
  Primer
tgctggacccaacacaaatg

SEQ ID NO: 1536 - DNA, 20 bp, Artificial Sequence
  Primer
tgccatccaaccactcagtc

SEQ ID NO: 1537 - DNA, 26 bp, Artificial Sequence
  Probe
ttcccagtttttcatctgcactgcca

SEQ ID NO: 1538 - DNA, 15 bp, Artificial Sequence
  Primer
gaggcccgcccaaca

SEQ ID NO: 1539 - DNA, 26 bp, Artificial Sequence
  Primer
ttctgctaatgacgttatccagtttt

SEQ ID NO: 1540 - DNA, 14 bp, Artificial Sequence
  Probe
ctgcctagatcggc

SEQ ID NO: 1541 - DNA, 20 bp, Artificial Sequence
  Synthetic oligonucleotide
gaagcccttgccagccatgt

SEQ ID NO: 1542 - DNA, 20 bp, Artificial Sequence
  Synthetic oligonucleotide
aaggagaagcccttgccagc

SEQ ID NO: 1543 - DNA, 20 bp, Artificial Sequence
  Synthetic oligonucleotide
tgcctcctccttgggaatgt

SEQ ID NO: 1544 - DNA, 20 bp, Artificial Sequence
  Synthetic oligonucleotide
acacaagacatttccttttt

SEQ ID NO: 1545 - DNA, 20 bp, Artificial Sequence
  Synthetic oligonucleotide
caaggaggctgttaactgaa

SEQ ID NO: 1546 - DNA, 20 bp, Artificial Sequence
  Synthetic oligonucleotide
accaaggaggctgttaactg

SEQ ID NO: 1547 - DNA, 20 bp, Artificial Sequence
  Synthetic oligonucleotide
gcaccaaggaggctgttaac

SEQ ID NO: 1548 - DNA, 20 bp, Artificial Sequence
  Synthetic oligonucleotide
aagcaccaaggaggctgtta

SEQ ID NO: 1549 - DNA, 20 bp, Artificial Sequence
  Synthetic oligonucleotide
taaagcaccaaggaggctgt

SEQ ID NO: 1550 - DNA, 20 bp, Artificial Sequence
  Synthetic oligonucleotide
cttaaagcaccaaggaggct

SEQ ID NO: 1551 - DNA, 20 bp, Artificial Sequence
  Synthetic oligonucleotide
tgcttaaagcaccaaggagg

SEQ ID NO: 1552 - DNA, 20 bp, Artificial Sequence
  Synthetic oligonucleotide
aatgcttaaagcaccaagga

SEQ ID NO: 1553 - DNA, 20 bp, Artificial Sequence
  Synthetic oligonucleotide
tgaatgcttaaagcaccaag

SEQ ID NO: 1554 - DNA, 20 bp, Artificial Sequence
  Synthetic oligonucleotide
gctgaatgcttaaagcacca

SEQ ID NO: 1555 - DNA, 20 bp, Artificial Sequence
  Synthetic oligonucleotide
aagctgaatgcttaaagcac

SEQ ID NO: 1556 - DNA, 20 bp, Artificial Sequence
  Synthetic oligonucleotide
ggaagctgaatgcttaaagc

SEQ ID NO: 1557 - DNA, 20 bp, Artificial Sequence
  Synthetic oligonucleotide
aaggaagctgaatgcttaaa

SEQ ID NO: 1558 - DNA, 20 bp, Artificial Sequence
  Synthetic oligonucleotide
tgaaggaagctgaatgctta

SEQ ID NO: 1559 - DNA, 20 bp, Artificial Sequence
  Synthetic oligonucleotide
cctgaaggaagctgaatgct

SEQ ID NO: 1560 - DNA, 20 bp, Artificial Sequence
  Synthetic oligonucleotide
taagggtttgacctgaagcc

SEQ ID NO: 1561 - DNA, 20 bp, Artificial Sequence
  Synthetic oligonucleotide
taaaccttcctatttcaaca

SEQ ID NO: 1562 - DNA, 20 bp, Artificial Sequence
  Synthetic oligonucleotide
cttaaaccttcctatttcaa

SEQ ID NO: 1563 - DNA, 20 bp, Artificial Sequence
  Synthetic oligonucleotide
tccttaaaccttcctatttc

SEQ ID NO: 1564 - DNA, 20 bp, Artificial Sequence
  Synthetic oligonucleotide
tctccttaaaccttcctatt

SEQ ID NO: 1565 - DNA, 20 bp, Artificial Sequence
  Synthetic oligonucleotide
attctccttaaaccttccta

SEQ ID NO: 1566 - DNA, 20 bp, Artificial Sequence
  Synthetic oligonucleotide
agattctccttaaaccttcc

SEQ ID NO: 1567 - DNA, 20 bp, Artificial Sequence
  Synthetic oligonucleotide
ttagattctccttaaacctt

SEQ ID NO: 1568 - DNA, 20 bp, Artificial Sequence
  Synthetic oligonucleotide
gcttagattctccttaaacc

SEQ ID NO: 1569 - DNA, 20 bp, Artificial Sequence
  Synthetic oligonucleotide
atgcttagattctccttaaa

SEQ ID NO: 1570 - DNA, 20 bp, Artificial Sequence
  Synthetic oligonucleotide
aaatgcttagattctcctta

SEQ ID NO: 1571 - DNA, 20 bp, Artificial Sequence
  Synthetic oligonucleotide
taaaatgcttagattctcct

SEQ ID NO: 1572 - DNA, 20 bp, Artificial Sequence
  Synthetic oligonucleotide
atacattacaaaggaaaata

SEQ ID NO: 1573 - DNA, 20 bp, Artificial Sequence
  Synthetic oligonucleotide
caatacattacaaaggaaaa

SEQ ID NO: 1574 - DNA, 20 bp, Artificial Sequence
  Synthetic oligonucleotide
caccctctgcccagccttac

SEQ ID NO: 1575 - DNA, 20 bp, Artificial Sequence
  Synthetic oligonucleotide
agcaccctctgcccagcctt

SEQ ID NO: 1576 - DNA, 20 bp, Artificial Sequence
  Synthetic oligonucleotide
taagcaccctctgcccagcc

SEQ ID NO: 1577 - DNA, 20 bp, Artificial Sequence
  Synthetic oligonucleotide
tgtaagcaccctctgcccag

SEQ ID NO: 1578 - DNA, 20 bp, Artificial Sequence
  Synthetic oligonucleotide
gttgtaagcaccctctgccc

SEQ ID NO: 1579 - DNA, 20 bp, Artificial Sequence
  Synthetic oligonucleotide
aggttgtaagcaccctctgc

SEQ ID NO: 1580 - DNA, 20 bp, Artificial Sequence
  Synthetic oligonucleotide
caaggttgtaagcaccctct

SEQ ID NO: 1581 - DNA, 20 bp, Artificial Sequence
  Synthetic oligonucleotide
gtcaaggttgtaagcaccct

SEQ ID NO: 1582 - DNA, 20 bp, Artificial Sequence
  Synthetic oligonucleotide
gagtcaaggttgtaagcacc

SEQ ID NO: 1583 - DNA, 20 bp, Artificial Sequence
  Synthetic oligonucleotide
gggagtcaaggttgtaagca

SEQ ID NO: 1584 - DNA, 20 bp, Artificial Sequence
  Synthetic oligonucleotide
aagggagtcaaggttgtaag

SEQ ID NO: 1585 - DNA, 20 bp, Artificial Sequence
  Synthetic oligonucleotide
gaaagggagtcaaggttgta

SEQ ID NO: 1586 - DNA, 20 bp, Artificial Sequence
  Synthetic oligonucleotide
gagaaagggagtcaaggttg

SEQ ID NO: 1587 - DNA, 20 bp, Artificial Sequence
  Synthetic oligonucleotide
atcaagtccagggagaaagg

SEQ ID NO: 1588 - DNA, 20 bp, Artificial Sequence
  Synthetic oligonucleotide
agatcaagtccagggagaaa

SEQ ID NO: 1589 - DNA, 20 bp, Artificial Sequence
  Synthetic oligonucleotide
gcagatcaagtccagggaga

SEQ ID NO: 1590 - DNA, 20 bp, Artificial Sequence
  Synthetic oligonucleotide
cagcagatcaagtccaggga

SEQ ID NO: 1591 - DNA, 20 bp, Artificial Sequence
  Synthetic oligonucleotide
aacagcagatcaagtccagg

SEQ ID NO: 1592 - DNA, 20 bp, Artificial Sequence
  Synthetic oligonucleotide
gaaacagcagatcaagtcca

SEQ ID NO: 1593 - DNA, 20 bp, Artificial Sequence
  Synthetic oligonucleotide
ctgaaacagcagatcaagtc

SEQ ID NO: 1594 - DNA, 20 bp, Artificial Sequence
  Synthetic oligonucleotide
ctctgaaacagcagatcaag

SEQ ID NO: 1595 - DNA, 20 bp, Artificial Sequence
  Synthetic oligonucleotide
gcctctgaaacagcagatca

SEQ ID NO: 1596 - DNA, 20 bp, Artificial Sequence
  Synthetic oligonucleotide
tagcctctgaaacagcagat

SEQ ID NO: 1597 - DNA, 20 bp, Artificial Sequence
  Synthetic oligonucleotide
cctagcctctgaaacagcag

SEQ ID NO: 1598 - DNA, 20 bp, Artificial Sequence
  Synthetic oligonucleotide
aacctagcctctgaaacagc

SEQ ID NO: 1599 - DNA, 20 bp, Artificial Sequence
  Synthetic oligonucleotide
acaacctagcctctgaaaca

SEQ ID NO: 1600 - DNA, 20 bp, Artificial Sequence
  Synthetic oligonucleotide
aaacaacctagcctctgaaa

SEQ ID NO: 1601 - DNA, 20 bp, Artificial Sequence
  Synthetic oligonucleotide
agaaacaacctagcctctga

SEQ ID NO: 1602 - DNA, 20 bp, Artificial Sequence
  Synthetic oligonucleotide
acagaaacaacctagcctct

SEQ ID NO: 1603 - DNA, 20 bp, Artificial Sequence
  Synthetic oligonucleotide
ccacagaaacaacctagcct

SEQ ID NO: 1604 - DNA, 20 bp, Artificial Sequence
  Synthetic oligonucleotide
acccacagaaacaacctagc

SEQ ID NO: 1605 - DNA, 20 bp, Artificial Sequence
  Synthetic oligonucleotide
gcacccacagaaacaaccta

SEQ ID NO: 1606 - DNA, 20 bp, Artificial Sequence
  Synthetic oligonucleotide
aggcacccacagaaacaacc

SEQ ID NO: 1607 - DNA, 20 bp, Artificial Sequence
  Synthetic oligonucleotide
taaggcacccacagaaacaa

SEQ ID NO: 1608 - DNA, 20 bp, Artificial Sequence
  Synthetic oligonucleotide
gataaggcacccacagaaac

SEQ ID NO: 1609 - DNA, 20 bp, Artificial Sequence
  Synthetic oligonucleotide
ctgataaggcacccacagaa

SEQ ID NO: 1610 - DNA, 20 bp, Artificial Sequence
  Synthetic oligonucleotide
ccctgataaggcacccacag

SEQ ID NO: 1611 - DNA, 20 bp, Artificial Sequence
  Synthetic oligonucleotide
agccctgataaggcacccac

SEQ ID NO: 1612 - DNA, 20 bp, Artificial Sequence
  Synthetic oligonucleotide
ccagccctgataaggcaccc

SEQ ID NO: 1613 - DNA, 20 bp, Artificial Sequence
  Synthetic oligonucleotide
tcccagccctgataaggcac

SEQ ID NO: 1614 - DNA, 20 bp, Artificial Sequence
  Synthetic oligonucleotide
tatcccagccctgataaggc

SEQ ID NO: 1615 - DNA, 20 bp, Artificial Sequence
  Synthetic oligonucleotide
agtatcccagccctgataag

SEQ ID NO: 1616 - DNA, 20 bp, Artificial Sequence
  Synthetic oligonucleotide
gaagtatcccagccctgata

SEQ ID NO: 1617 - DNA, 20 bp, Artificial Sequence
  Synthetic oligonucleotide
cagaagtatcccagccctga

SEQ ID NO: 1618 - DNA, 20 bp, Artificial Sequence
  Synthetic oligonucleotide
atcagaagtatcccagccct

SEQ ID NO: 1619 - DNA, 20 bp, Artificial Sequence
  Synthetic oligonucleotide
gattcctaaaacaaacagga

SEQ ID NO: 1620 - DNA, 20 bp, Artificial Sequence
  Synthetic oligonucleotide
aggattcctaaaacaaacag

SEQ ID NO: 1621 - DNA, 20 bp, Artificial Sequence
  Synthetic oligonucleotide
ccaggattcctaaaacaaac

SEQ ID NO: 1622 - DNA, 20 bp, Artificial Sequence
  Synthetic oligonucleotide
gaccaggattcctaaaacaa

SEQ ID NO: 1623 - DNA, 20 bp, Artificial Sequence
  Synthetic oligonucleotide
gagaccaggattcctaaaac

SEQ ID NO: 1624 - DNA, 20 bp, Artificial Sequence
  Synthetic oligonucleotide
ctgagaccaggattcctaaa

SEQ ID NO: 1625 - DNA, 20 bp, Artificial Sequence
  Synthetic oligonucleotide
tcctgagaccaggattccta

SEQ ID NO: 1626 - DNA, 20 bp, Artificial Sequence
  Synthetic oligonucleotide
ggtcctgagaccaggattcc

SEQ ID NO: 1627 - DNA, 20 bp, Artificial Sequence
  Synthetic oligonucleotide
gaggtcctgagaccaggatt

SEQ ID NO: 1628 - DNA, 20 bp, Artificial Sequence
  Synthetic oligonucleotide
atgaggtcctgagaccagga

SEQ ID NO: 1629 - DNA, 20 bp, Artificial Sequence
  Synthetic oligonucleotide
ccatgaggtcctgagaccag

SEQ ID NO: 1630 - DNA, 20 bp, Artificial Sequence
  Synthetic oligonucleotide
ttccatgaggtcctgagacc

SEQ ID NO: 1631 - DNA, 20 bp, Artificial Sequence
  Synthetic oligonucleotide
tcttccatgaggtcctgaga

SEQ ID NO: 1632 - DNA, 20 bp, Artificial Sequence
  Synthetic oligonucleotide
cttcttccatgaggtcctga

SEQ ID NO: 1633 - DNA, 20 bp, Artificial Sequence
  Synthetic oligonucleotide
ctcttcttccatgaggtcct

SEQ ID NO: 1634 - DNA, 20 bp, Artificial Sequence
  Synthetic oligonucleotide
ccctcttcttccatgaggtc

SEQ ID NO: 1635 - DNA, 20 bp, Artificial Sequence
  Synthetic oligonucleotide
ccccctcttcttccatgagg

SEQ ID NO: 1636 - DNA, 20 bp, Artificial Sequence
  Synthetic oligonucleotide
ctccccctcttcttccatga

SEQ ID NO: 1637 - DNA, 20 bp, Artificial Sequence
  Synthetic oligonucleotide
cctgagctcaaccagacacg

SEQ ID NO: 1638 - DNA, 20 bp, Artificial Sequence
  Synthetic oligonucleotide
tccctgagctcaaccagaca

SEQ ID NO: 1639 - DNA, 20 bp, Artificial Sequence
  Synthetic oligonucleotide
attccctgagctcaaccaga

SEQ ID NO: 1640 - DNA, 20 bp, Artificial Sequence
  Synthetic oligonucleotide
atattccctgagctcaacca

SEQ ID NO: 1641 - DNA, 20 bp, Artificial Sequence
  Synthetic oligonucleotide
ccatattccctgagctcaac

SEQ ID NO: 1642 - DNA, 20 bp, Artificial Sequence
  Synthetic oligonucleotide
aaccatattccctgagctca

SEQ ID NO: 1643 - DNA, 20 bp, Artificial Sequence
  Synthetic oligonucleotide
agaaccatattccctgagct

SEQ ID NO: 1644 - DNA, 20 bp, Artificial Sequence
  Synthetic oligonucleotide
taagaaccatattccctgag

SEQ ID NO: 1645 - DNA, 20 bp, Artificial Sequence
  Synthetic oligonucleotide
gctaagaaccatattccctg

SEQ ID NO: 1646 - DNA, 20 bp, Artificial Sequence
  Synthetic oligonucleotide
tcagtaagcctttgccctgc

SEQ ID NO: 1647 - DNA, 20 bp, Artificial Sequence
  Synthetic oligonucleotide
tatcagtaagcctttgccct

SEQ ID NO: 1648 - DNA, 20 bp, Artificial Sequence
  Synthetic oligonucleotide
tttatcagtaagcctttgcc

SEQ ID NO: 1649 - DNA, 20 bp, Artificial Sequence
  Synthetic oligonucleotide
agtttatcagtaagcctttg

SEQ ID NO: 1650 - DNA, 20 bp, Artificial Sequence
  Synthetic oligonucleotide
caagtttatcagtaagcctt

SEQ ID NO: 1651 - DNA, 20 bp, Artificial Sequence
  Synthetic oligonucleotide
ctcaagtttatcagtaagcc

SEQ ID NO: 1652 - DNA, 20 bp, Artificial Sequence
  Synthetic oligonucleotide
gactcaagtttatcagtaag

SEQ ID NO: 1653 - DNA, 20 bp, Artificial Sequence
  Synthetic oligonucleotide
cagactcaagtttatcagta

SEQ ID NO: 1654 - DNA, 20 bp, Artificial Sequence
  Synthetic oligonucleotide
ggcagactcaagtttatcag

SEQ ID NO: 1655 - DNA, 20 bp, Artificial Sequence
  Synthetic oligonucleotide
agggcagactcaagtttatc

SEQ ID NO: 1656 - DNA, 20 bp, Artificial Sequence
  Synthetic oligonucleotide
cgagggcagactcaagttta

SEQ ID NO: 1657 - DNA, 20 bp, Artificial Sequence
  Synthetic oligonucleotide
tacgagggcagactcaagtt

SEQ ID NO: 1658 - DNA, 20 bp, Artificial Sequence
  Synthetic oligonucleotide
catacgagggcagactcaag

SEQ ID NO: 1659 - DNA, 20 bp, Artificial Sequence
  Synthetic oligonucleotide
ctcatacgagggcagactca

SEQ ID NO: 1660 - DNA, 20 bp, Artificial Sequence
  Synthetic oligonucleotide
ccctcatacgagggcagact

SEQ ID NO: 1661 - DNA, 20 bp, Artificial Sequence
  Synthetic oligonucleotide
cagcctcagagggaggccag

SEQ ID NO: 1662 - DNA, 20 bp, Artificial Sequence
  Synthetic oligonucleotide
accagcctcagagggaggcc

SEQ ID NO: 1663 - DNA, 20 bp, Artificial Sequence
  Synthetic oligonucleotide
tcaccagcctcagagggagg

SEQ ID NO: 1664 - DNA, 20 bp, Artificial Sequence
  Synthetic oligonucleotide
agtcaccagcctcagaggga

SEQ ID NO: 1665 - DNA, 20 bp, Artificial Sequence
  Synthetic oligonucleotide
cccatacgcacaggagaggc

SEQ ID NO: 1666 - DNA, 20 bp, Artificial Sequence
  Synthetic oligonucleotide
ttcccatacgcacaggagag

SEQ ID NO: 1667 - DNA, 20 bp, Artificial Sequence
  Synthetic oligonucleotide
tgttcccatacgcacaggag

SEQ ID NO: 1668 - DNA, 20 bp, Artificial Sequence
  Synthetic oligonucleotide
ggtgttcccatacgcacagg

SEQ ID NO: 1669 - DNA, 20 bp, Artificial Sequence
  Synthetic oligonucleotide
taggtgttcccatacgcaca

SEQ ID NO: 1670 - DNA, 20 bp, Artificial Sequence
  Synthetic oligonucleotide
gctaggtgttcccatacgca

SEQ ID NO: 1671 - DNA, 20 bp, Artificial Sequence
  Synthetic oligonucleotide
gtgctaggtgttcccatacg

SEQ ID NO: 1672 - DNA, 20 bp, Artificial Sequence
  Synthetic oligonucleotide
gaggcaaggtggttttgagt

SEQ ID NO: 1673 - DNA, 20 bp, Artificial Sequence
  Synthetic oligonucleotide
ctgaggcaaggtggttttga

SEQ ID NO: 1674 - DNA, 20 bp, Artificial Sequence
  Synthetic oligonucleotide
agctgaggcaaggtggtttt

SEQ ID NO: 1675 - DNA, 20 bp, Artificial Sequence
  Synthetic oligonucleotide
tcagctgaggcaaggtggtt

SEQ ID NO: 1676 - DNA, 20 bp, Artificial Sequence
  Synthetic oligonucleotide
gatcagctgaggcaaggtgg

SEQ ID NO: 1677 - DNA, 20 bp, Artificial Sequence
  Synthetic oligonucleotide
ctgatcagctgaggcaaggt

SEQ ID NO: 1678 - DNA, 20 bp, Artificial Sequence
  Synthetic oligonucleotide
ctctgatcagctgaggcaag

SEQ ID NO: 1679 - DNA, 20 bp, Artificial Sequence
  Synthetic oligonucleotide
aactctgatcagctgaggca

SEQ ID NO: 1680 - DNA, 20 bp, Artificial Sequence
  Synthetic oligonucleotide
gaaactctgatcagctgagg

SEQ ID NO: 1681 - DNA, 20 bp, Artificial Sequence
  Synthetic oligonucleotide
cagaaactctgatcagctga

SEQ ID NO: 1682 - DNA, 20 bp, Artificial Sequence
  Synthetic oligonucleotide
cagagaccagctaatttgat

SEQ ID NO: 1683 - DNA, 20 bp, Artificial Sequence
  Synthetic oligonucleotide
ttcagagaccagctaatttg

SEQ ID NO: 1684 - DNA, 20 bp, Artificial Sequence
  Synthetic oligonucleotide
aattcagagaccagctaatt

SEQ ID NO: 1685 - DNA, 20 bp, Artificial Sequence
  Synthetic oligonucleotide
ttaattcagagaccagctaa

SEQ ID NO: 1686 - DNA, 20 bp, Artificial Sequence
  Synthetic oligonucleotide
ctccaggcaggaggactggg

SEQ ID NO: 1687 - DNA, 20 bp, Artificial Sequence
  Synthetic oligonucleotide
gtctccaggcaggaggactg

SEQ ID NO: 1688 - DNA, 20 bp, Artificial Sequence
  Synthetic oligonucleotide
ctgtctccaggcaggaggac

SEQ ID NO: 1689 - DNA, 20 bp, Artificial Sequence
  Synthetic oligonucleotide
aactgtctccaggcaggagg

SEQ ID NO: 1690 - DNA, 20 bp, Artificial Sequence
  Synthetic oligonucleotide
tcaactgtctccaggcagga

SEQ ID NO: 1691 - DNA, 20 bp, Artificial Sequence
  Synthetic oligonucleotide
catcaactgtctccaggcag

SEQ ID NO: 1692 - DNA, 20 bp, Artificial Sequence
  Synthetic oligonucleotide
cacatcaactgtctccaggc

SEQ ID NO: 1693 - DNA, 20 bp, Artificial Sequence
  Synthetic oligonucleotide
gacacatcaactgtctccag

SEQ ID NO: 1694 - DNA, 20 bp, Artificial Sequence
  Synthetic oligonucleotide
gaagagtgttgctggagaag

SEQ ID NO: 1695 - DNA, 20 bp, Artificial Sequence
  Synthetic oligonucleotide
ctgaagagtgttgctggaga

SEQ ID NO: 1696 - DNA, 20 bp, Artificial Sequence
  Synthetic oligonucleotide
tactgaagagtgttgctgga

SEQ ID NO: 1697 - DNA, 20 bp, Artificial Sequence
  Synthetic oligonucleotide
tgtactgaagagtgttgctg

SEQ ID NO: 1698 - DNA, 20 bp, Artificial Sequence
  Synthetic oligonucleotide
tatgtactgaagagtgttgc

SEQ ID NO: 1699 - DNA, 20 bp, Artificial Sequence
  Synthetic oligonucleotide
attatgtactgaagagtgtt

SEQ ID NO: 1700 - DNA, 20 bp, Artificial Sequence
  Synthetic oligonucleotide
ttattatgtactgaagagtg

SEQ ID NO: 1701 - DNA, 20 bp, Artificial Sequence
  Synthetic oligonucleotide
gcttattatgtactgaagag

SEQ ID NO: 1702 - DNA, 20 bp, Artificial Sequence
  Synthetic oligonucleotide
aagcttattatgtactgaag

SEQ ID NO: 1703 - DNA, 20 bp, Artificial Sequence
  Synthetic oligonucleotide
ttaagcttattatgtactga

SEQ ID NO: 1704 - DNA, 20 bp, Artificial Sequence
  Synthetic oligonucleotide
agttaagcttattatgtact

SEQ ID NO: 1705 - DNA, 20 bp, Artificial Sequence
  Synthetic oligonucleotide
tcagttaagcttattatgta

SEQ ID NO: 1706 - DNA, 20 bp, Artificial Sequence
  Synthetic oligonucleotide
tatcagttaagcttattatg

SEQ ID NO: 1707 - DNA, 20 bp, Artificial Sequence
  Synthetic oligonucleotide
tttatcagttaagcttatta

SEQ ID NO: 1708 - DNA, 20 bp, Artificial Sequence
  Synthetic oligonucleotide
tgtttatcagttaagcttat

SEQ ID NO: 1709 - DNA, 20 bp, Artificial Sequence
  Synthetic oligonucleotide
tctgtttatcagttaagctt

SEQ ID NO: 1710 - DNA, 20 bp, Artificial Sequence
  Synthetic oligonucleotide
aacccaatggtaagcccaag

SEQ ID NO: 1711 - DNA, 20 bp, Artificial Sequence
  Synthetic oligonucleotide
taaacccaatggtaagccca

SEQ ID NO: 1712 - DNA, 20 bp, Artificial Sequence
  Synthetic oligonucleotide
tttaaacccaatggtaagcc

SEQ ID NO: 1713 - DNA, 20 bp, Artificial Sequence
  Synthetic oligonucleotide
gatttaaacccaatggtaag

SEQ ID NO: 1714 - DNA, 20 bp, Artificial Sequence
  Synthetic oligonucleotide
atgatttaaacccaatggta

SEQ ID NO: 1715 - DNA, 20 bp, Artificial Sequence
  Synthetic oligonucleotide
ctatgatttaaacccaatgg

SEQ ID NO: 1716 - DNA, 20 bp, Artificial Sequence
  Synthetic oligonucleotide
ccctatgatttaaacccaat

SEQ ID NO: 1717 - DNA, 20 bp, Artificial Sequence
  Synthetic oligonucleotide
gtccctatgatttaaaccca

SEQ ID NO: 1718 - DNA, 20 bp, Artificial Sequence
  Synthetic oligonucleotide
aggtccctatgatttaaacc

SEQ ID NO: 1719 - DNA, 20 bp, Artificial Sequence
  Synthetic oligonucleotide
tatctgctccagagaagccc

SEQ ID NO: 1720 - DNA, 20 bp, Artificial Sequence
  Synthetic oligonucleotide
aatatctgctccagagaagc

SEQ ID NO: 1721 - DNA, 20 bp, Artificial Sequence
  Synthetic oligonucleotide
ctacctaaggccatgaactt

SEQ ID NO: 1722 - DNA, 20 bp, Artificial Sequence
  Synthetic oligonucleotide
tgctacctaaggccatgaac

SEQ ID NO: 1723 - DNA, 20 bp, Artificial Sequence
  Synthetic oligonucleotide
catgctacctaaggccatga

SEQ ID NO: 1724 - DNA, 20 bp, Artificial Sequence
  Synthetic oligonucleotide
cagagttaagaccagataca

SEQ ID NO: 1725 - DNA, 20 bp, Artificial Sequence
  Synthetic oligonucleotide
atcagagttaagaccagata

SEQ ID NO: 1726 - DNA, 20 bp, Artificial Sequence
  Synthetic oligonucleotide
caatcagagttaagaccaga

SEQ ID NO: 1727 - DNA, 20 bp, Artificial Sequence
  Synthetic oligonucleotide
tacaatcagagttaagacca

SEQ ID NO: 1728 - DNA, 20 bp, Artificial Sequence
  Synthetic oligonucleotide
gctacaatcagagttaagac

SEQ ID NO: 1729 - DNA, 20 bp, Artificial Sequence
  Synthetic oligonucleotide
ttgctacaatcagagttaag

SEQ ID NO: 1730 - DNA, 20 bp, Artificial Sequence
  Synthetic oligonucleotide
ttttgctacaatcagagtta

SEQ ID NO: 1731 - DNA, 20 bp, Artificial Sequence
  Synthetic oligonucleotide
acttttgctacaatcagagt

SEQ ID NO: 1732 - DNA, 20 bp, Artificial Sequence
  Synthetic oligonucleotide
gaacttttgctacaatcaga

SEQ ID NO: 1733 - DNA, 20 bp, Artificial Sequence
  Synthetic oligonucleotide
cagaacttttgctacaatca

SEQ ID NO: 1734 - DNA, 20 bp, Artificial Sequence
  Synthetic oligonucleotide
ctcagaacttttgctacaat

SEQ ID NO: 1735 - DNA, 20 bp, Artificial Sequence
  Synthetic oligonucleotide
ctctcagaacttttgctaca

SEQ ID NO: 1736 - DNA, 20 bp, Artificial Sequence
  Synthetic oligonucleotide
tcctctcagaacttttgcta

SEQ ID NO: 1737 - DNA, 20 bp, Artificial Sequence
  Synthetic oligonucleotide
gctcctctcagaacttttgc

SEQ ID NO: 1738 - DNA, 20 bp, Artificial Sequence
  Synthetic oligonucleotide
cagctcctctcagaactttt

SEQ ID NO: 1739 - DNA, 20 bp, Artificial Sequence
  Synthetic oligonucleotide
ctcagctcctctcagaactt

SEQ ID NO: 1740 - DNA, 20 bp, Artificial Sequence
  Synthetic oligonucleotide
ggctcagctcctctcagaac

SEQ ID NO: 1741 - DNA, 20 bp, Artificial Sequence
  Synthetic oligonucleotide
gcaacccacgggattccctc

SEQ ID NO: 1742 - DNA, 20 bp, Artificial Sequence
  Synthetic oligonucleotide
aagcaacccacgggattccc

SEQ ID NO: 1743 - DNA, 20 bp, Artificial Sequence
  Synthetic oligonucleotide
gtaagcaacccacgggattc

SEQ ID NO: 1744 - DNA, 20 bp, Artificial Sequence
  Synthetic oligonucleotide
aggtaagcaacccacgggat

SEQ ID NO: 1745 - DNA, 20 bp, Artificial Sequence
  Synthetic oligonucleotide
gtaggtaagcaacccacggg

SEQ ID NO: 1746 - DNA, 20 bp, Artificial Sequence
  Synthetic oligonucleotide
aggtaggtaagcaacccacg

SEQ ID NO: 1747 - DNA, 20 bp, Artificial Sequence
  Synthetic oligonucleotide
ataggtaggtaagcaaccca

SEQ ID NO: 1748 - DNA, 20 bp, Artificial Sequence
  Synthetic oligonucleotide
ttataggtaggtaagcaacc

SEQ ID NO: 1749 - DNA, 20 bp, Artificial Sequence
  Synthetic oligonucleotide
ccttataggtaggtaagcaa

SEQ ID NO: 1750 - DNA, 20 bp, Artificial Sequence
  Synthetic oligonucleotide
caccttataggtaggtaagc

SEQ ID NO: 1751 - DNA, 20 bp, Artificial Sequence
  Synthetic oligonucleotide
accaccttataggtaggtaa

SEQ ID NO: 1752 - DNA, 20 bp, Artificial Sequence
  Synthetic oligonucleotide
aaaccaccttataggtaggt

SEQ ID NO: 1753 - DNA, 20 bp, Artificial Sequence
  Synthetic oligonucleotide
ataaaccaccttataggtag

SEQ ID NO: 1754 - DNA, 20 bp, Artificial Sequence
  Synthetic oligonucleotide
ttataaaccaccttataggt

SEQ ID NO: 1755 - DNA, 20 bp, Artificial Sequence
  Synthetic oligonucleotide
gcttataaaccaccttatag

SEQ ID NO: 1756 - DNA, 20 bp, Artificial Sequence
  Synthetic oligonucleotide
cagcttataaaccaccttat

SEQ ID NO: 1757 - DNA, 20 bp, Artificial Sequence
  Synthetic oligonucleotide
agcagcttataaaccacctt

SEQ ID NO: 1758 - DNA, 20 bp, Artificial Sequence
  Synthetic oligonucleotide
acagcagcttataaaccacc

SEQ ID NO: 1759 - DNA, 20 bp, Artificial Sequence
  Synthetic oligonucleotide
ggacagcagcttataaacca

SEQ ID NO: 1760 - DNA, 20 bp, Artificial Sequence
  Synthetic oligonucleotide
caggacagcagcttataaac

SEQ ID NO: 1761 - DNA, 20 bp, Artificial Sequence
  Synthetic oligonucleotide
gccaggacagcagcttataa

SEQ ID NO: 1762 - DNA, 20 bp, Artificial Sequence
  Synthetic oligonucleotide
tggccaggacagcagcttat

SEQ ID NO: 1763 - DNA, 20 bp, Artificial Sequence
  Synthetic oligonucleotide
agtggccaggacagcagctt

SEQ ID NO: 1764 - DNA, 20 bp, Artificial Sequence
  Synthetic oligonucleotide
gcagtggccaggacagcagc

SEQ ID NO: 1765 - DNA, 20 bp, Artificial Sequence
  Synthetic oligonucleotide
atgcagtggccaggacagca

SEQ ID NO: 1766 - DNA, 20 bp, Artificial Sequence
  Synthetic oligonucleotide
gaatgcagtggccaggacag

SEQ ID NO: 1767 - DNA, 20 bp, Artificial Sequence
  Synthetic oligonucleotide
ttgaatgcagtggccaggac

SEQ ID NO: 1768 - DNA, 20 bp, Artificial Sequence
  Synthetic oligonucleotide
atttgaatgcagtggccagg

SEQ ID NO: 1769 - DNA, 20 bp, Artificial Sequence
  Synthetic oligonucleotide
gaatttgaatgcagtggcca

SEQ ID NO: 1770 - DNA, 20 bp, Artificial Sequence
  Synthetic oligonucleotide
tggaatttgaatgcagtggc

SEQ ID NO: 1771 - DNA, 20 bp, Artificial Sequence
  Synthetic oligonucleotide
attggaatttgaatgcagtg

SEQ ID NO: 1772 - DNA, 20 bp, Artificial Sequence
  Synthetic oligonucleotide
acattggaatttgaatgcag

SEQ ID NO: 1773 - DNA, 20 bp, Artificial Sequence
  Synthetic oligonucleotide
acacattggaatttgaatgc

SEQ ID NO: 1774 - DNA, 20 bp, Artificial Sequence
  Synthetic oligonucleotide
gtacacattggaatttgaat

SEQ ID NO: 1775 - DNA, 20 bp, Artificial Sequence
  Synthetic oligonucleotide
aagtacacattggaatttga

SEQ ID NO: 1776 - DNA, 20 bp, Artificial Sequence
  Synthetic oligonucleotide
tgaagtacacattggaattt

SEQ ID NO: 1777 - DNA, 20 bp, Artificial Sequence
  Synthetic oligonucleotide
tatgaagtacacattggaat

SEQ ID NO: 1778 - DNA, 20 bp, Artificial Sequence
  Synthetic oligonucleotide
actatgaagtacacattgga

SEQ ID NO: 1779 - DNA, 20 bp, Artificial Sequence
  Synthetic oligonucleotide
acactatgaagtacacattg

SEQ ID NO: 1780 - DNA, 20 bp, Artificial Sequence
  Synthetic oligonucleotide
ttacactatgaagtacacat

SEQ ID NO: 1781 - DNA, 20 bp, Artificial Sequence
  Synthetic oligonucleotide
ttttacactatgaagtacac

SEQ ID NO: 1782 - DNA, 20 bp, Artificial Sequence
  Synthetic oligonucleotide
atttttacactatgaagtac

SEQ ID NO: 1783 - DNA, 20 bp, Artificial Sequence
  Synthetic oligonucleotide
aaatttttacactatgaagt

SEQ ID NO: 1784 - DNA, 20 bp, Artificial Sequence
  Synthetic oligonucleotide
ataaatttttacactatgaa

SEQ ID NO: 1785 - DNA, 20 bp, Artificial Sequence
  Synthetic oligonucleotide
atataaatttttacactatg

SEQ ID NO: 1786 - DNA, 20 bp, Artificial Sequence
  Synthetic oligonucleotide
taatataaatttttacacta

SEQ ID NO: 1787 - DNA, 20 bp, Artificial Sequence
  Synthetic oligonucleotide
aataatataaatttttacac

SEQ ID NO: 1788 - DNA, 20 bp, Artificial Sequence
  Synthetic oligonucleotide
acaataatataaatttttac

SEQ ID NO: 1789 - DNA, 20 bp, Artificial Sequence
  Synthetic oligonucleotide
agttaaagtagatacagcaa

SEQ ID NO: 1790 - DNA, 20 bp, Artificial Sequence
  Synthetic oligonucleotide
gaagttaaagtagatacagc

SEQ ID NO: 1791 - DNA, 20 bp, Artificial Sequence
  Synthetic oligonucleotide
tggaagttaaagtagataca

SEQ ID NO: 1792 - DNA, 20 bp, Artificial Sequence
  Synthetic oligonucleotide
tctggaagttaaagtagata

SEQ ID NO: 1793 - DNA, 20 bp, Artificial Sequence
  Synthetic oligonucleotide
tttctggaagttaaagtaga

SEQ ID NO: 1794 - DNA, 20 bp, Artificial Sequence
  Synthetic oligonucleotide
tatttctggaagttaaagta

SEQ ID NO: 1795 - DNA, 20 bp, Artificial Sequence
  Synthetic oligonucleotide
tttatttctggaagttaaag

SEQ ID NO: 1796 - DNA, 20 bp, Artificial Sequence
  Synthetic oligonucleotide
cgtttatttctggaagttaa

SEQ ID NO: 1797 - DNA, 20 bp, Artificial Sequence
  Synthetic oligonucleotide
cacgccgtcatgcataattc

SEQ ID NO: 1798 - DNA, 20 bp, Artificial Sequence
  Synthetic oligonucleotide
ggcacgccgtcatgcataat

SEQ ID NO: 1799 - DNA, 20 bp, Artificial Sequence
  Synthetic oligonucleotide
gcccagccccagcctggccg

SEQ ID NO: 1800 - DNA, 20 bp, Artificial Sequence
  Synthetic oligonucleotide
acagccccttcagccaatcc

SEQ ID NO: 1801 - DNA, 20 bp, Artificial Sequence
  Synthetic oligonucleotide
ttacagccccttcagccaat

SEQ ID NO: 1802 - DNA, 20 bp, Artificial Sequence
  Synthetic oligonucleotide
aattacagccccttcagcca

SEQ ID NO: 1803 - DNA, 20 bp, Artificial Sequence
  Synthetic oligonucleotide
tgaattacagccccttcagc

SEQ ID NO: 1804 - DNA, 20 bp, Artificial Sequence
  Synthetic oligonucleotide
gctgaattacagccccttca

SEQ ID NO: 1805 - DNA, 20 bp, Artificial Sequence
  Synthetic oligonucleotide
ccgctgaattacagcccctt

SEQ ID NO: 1806 - DNA, 20 bp, Artificial Sequence
  Synthetic oligonucleotide
aaccgctgaattacagcccc

SEQ ID NO: 1807 - DNA, 20 bp, Artificial Sequence
  Synthetic oligonucleotide
gaaaccgctgaattacagcc

SEQ ID NO: 1808 - DNA, 20 bp, Artificial Sequence
  Synthetic oligonucleotide
cggaaaccgctgaattacag

SEQ ID NO: 1809 - DNA, 20 bp, Artificial Sequence
  Synthetic oligonucleotide
tccggaaaccgctgaattac

SEQ ID NO: 1810 - DNA, 20 bp, Artificial Sequence
  Synthetic oligonucleotide
gctccggaaaccgctgaatt

SEQ ID NO: 1811 - DNA, 20 bp, Artificial Sequence
  Synthetic oligonucleotide
cagctccggaaaccgctgaa

SEQ ID NO: 1812 - DNA, 20 bp, Artificial Sequence
  Synthetic oligonucleotide
cgcagctccggaaaccgctg

SEQ ID NO: 1813 - DNA, 20 bp, Artificial Sequence
  Synthetic oligonucleotide
gccgcagctccggaaaccgc

SEQ ID NO: 1814 - DNA, 20 bp, Artificial Sequence
  Synthetic oligonucleotide
agtcccttccgaggcccgct

SEQ ID NO: 1815 - DNA, 20 bp, Artificial Sequence
  Synthetic oligonucleotide
cgaagaacgaaacttccctc

SEQ ID NO: 1816 - DNA, 20 bp, Artificial Sequence
  Synthetic oligonucleotide
cagacacacctattcctgcc

SEQ ID NO: 1817 - DNA, 20 bp, Artificial Sequence
  Synthetic oligonucleotide
ttatgcaataaagcctaccc

SEQ ID NO: 1818 - DNA, 20 bp, Artificial Sequence
  Synthetic oligonucleotide
ttagaaagagtaccggtctg

SEQ ID NO: 1819 - DNA, 20 bp, Artificial Sequence
  Synthetic oligonucleotide
aatggctcaattatttatct

SEQ ID NO: 1820 - DNA, 20 bp, Artificial Sequence
  Synthetic oligonucleotide
tttacccaagatcttggctc

SEQ ID NO: 1821 - DNA, 20 bp, Artificial Sequence
  Synthetic oligonucleotide
acttcagtgcaaccacaccc

SEQ ID NO: 1822 - DNA, 20 bp, Artificial Sequence
  Synthetic oligonucleotide
ccaacttgggcgacggtttg

SEQ ID NO: 1823 - DNA, 20 bp, Artificial Sequence
  Synthetic oligonucleotide
ctaaccactgattttgtcac

SEQ ID NO: 1824 - DNA, 20 bp, Artificial Sequence
  Synthetic oligonucleotide
gtacacactatacacatttt

SEQ ID NO: 1825 - DNA, 20 bp, Artificial Sequence
  Synthetic oligonucleotide
ctttagttgcacatacagta

SEQ ID NO: 1826 - DNA, 20 bp, Artificial Sequence
  Synthetic oligonucleotide
gccaaaaatttacaacccat

SEQ ID NO: 1827 - DNA, 20 bp, Artificial Sequence
  Synthetic oligonucleotide
ttcaagcccaatgctttatc

SEQ ID NO: 1828 - DNA, 20 bp, Artificial Sequence
  Synthetic oligonucleotide
ctggaacatgtaataaggaa

SEQ ID NO: 1829 - DNA, 20 bp, Artificial Sequence
  Synthetic oligonucleotide
agagactaaaatcaaggctc

SEQ ID NO: 1830 - DNA, 20 bp, Artificial Sequence
  Synthetic oligonucleotide
tagactctagacccaattcc

SEQ ID NO: 1831 - DNA, 20 bp, Artificial Sequence
  Synthetic oligonucleotide
gaaatgaccactgatcaagc

SEQ ID NO: 1832 - DNA, 20 bp, Artificial Sequence
  Synthetic oligonucleotide
aagttggtcaccacctctac

SEQ ID NO: 1833 - DNA, 20 bp, Artificial Sequence
  Synthetic oligonucleotide
aacttattcttcatagcaac

SEQ ID NO: 1834 - DNA, 20 bp, Artificial Sequence
  Synthetic oligonucleotide
tatttgggacccagttgaaa

SEQ ID NO: 1835 - DNA, 20 bp, Artificial Sequence
  Synthetic oligonucleotide
agaactgaaattccttggtc

SEQ ID NO: 1836 - DNA, 20 bp, Artificial Sequence
  Synthetic oligonucleotide
aagttttaaaagcttcccct

SEQ ID NO: 1837 - DNA, 20 bp, Artificial Sequence
  Synthetic oligonucleotide
tcacccaaagtaccaaatca

SEQ ID NO: 1838 - DNA, 20 bp, Artificial Sequence
  Synthetic oligonucleotide
caaaagttatggtgaaattt

SEQ ID NO: 1839 - DNA, 20 bp, Artificial Sequence
  Synthetic oligonucleotide
aagtactctttcagtggttt

SEQ ID NO: 1840 - DNA, 20 bp, Artificial Sequence
  Synthetic oligonucleotide
aattaaagagttgcggtaat

SEQ ID NO: 1841 - DNA, 20 bp, Artificial Sequence
  Synthetic oligonucleotide
gtttcatgaaaacggacaat

SEQ ID NO: 1842 - DNA, 20 bp, Artificial Sequence
  Synthetic oligonucleotide
aggattcagtcccagatctg

SEQ ID NO: 1843 - DNA, 20 bp, Artificial Sequence
  Synthetic oligonucleotide
tcaataatgatgactttctc

SEQ ID NO: 1844 - DNA, 20 bp, Artificial Sequence
  Synthetic oligonucleotide
ttaaacccaattattaacag

SEQ ID NO: 1845 - DNA, 20 bp, Artificial Sequence
  Synthetic oligonucleotide
gtaaaacacacattttatat

SEQ ID NO: 1846 - DNA, 20 bp, Artificial Sequence
  Synthetic oligonucleotide
gtaaacagaaagggctgcaa

SEQ ID NO: 1847 - DNA, 20 bp, Artificial Sequence
  Synthetic oligonucleotide
gggcagatttaccttcctta

SEQ ID NO: 1848 - DNA, 20 bp, Artificial Sequence
  Synthetic oligonucleotide
gggtagcaggaaggaaagcc

SEQ ID NO: 1849 - DNA, 20 bp, Artificial Sequence
  Synthetic oligonucleotide
aatataagttctttggctga

SEQ ID NO: 1850 - DNA, 20 bp, Artificial Sequence
  Synthetic oligonucleotide
tacaatagcaatcaccttag

SEQ ID NO: 1851 - DNA, 20 bp, Artificial Sequence
  Synthetic oligonucleotide
ccatgaaaccctcaaacata

SEQ ID NO: 1852 - DNA, 20 bp, Artificial Sequence
  Synthetic oligonucleotide
acctgcccctatgtataagc

SEQ ID NO: 1853 - DNA, 20 bp, Artificial Sequence
  Synthetic oligonucleotide
tttgtaatatctaacagata

SEQ ID NO: 1854 - DNA, 20 bp, Artificial Sequence
  Synthetic oligonucleotide
tatatgacagcctcaatttc

SEQ ID NO: 1855 - DNA, 20 bp, Artificial Sequence
  Synthetic oligonucleotide
ggcatttgtgtaaacaggaa

SEQ ID NO: 1856 - DNA, 20 bp, Artificial Sequence
  Synthetic oligonucleotide
tgttaaatattacttaaaat

SEQ ID NO: 1857 - DNA, 20 bp, Artificial Sequence
  Synthetic oligonucleotide
aattccttgggtggtaatcc

SEQ ID NO: 1858 - DNA, 20 bp, Artificial Sequence
  Synthetic oligonucleotide
ggaaagttacaggacaggaa

SEQ ID NO: 1859 - DNA, 20 bp, Artificial Sequence
  Synthetic oligonucleotide
gaaatggcttctacaaaaac

SEQ ID NO: 1860 - DNA, 20 bp, Artificial Sequence
  Synthetic oligonucleotide
ggtcagaataccacaaacta

SEQ ID NO: 1861 - DNA, 20 bp, Artificial Sequence
  Synthetic oligonucleotide
agtctaatgcttttagattc

SEQ ID NO: 1862 - DNA, 20 bp, Artificial Sequence
  Synthetic oligonucleotide
cattggaaaacttagggtaa

SEQ ID NO: 1863 - DNA, 20 bp, Artificial Sequence
  Synthetic oligonucleotide
attctcactgggtatagagg

SEQ ID NO: 1864 - DNA, 20 bp, Artificial Sequence
  Synthetic oligonucleotide
tagcattaatctttcctagg

SEQ ID NO: 1865 - DNA, 20 bp, Artificial Sequence
  Synthetic oligonucleotide
gactcaaaataaggttcctc

SEQ ID NO: 1866 - DNA, 20 bp, Artificial Sequence
  Synthetic oligonucleotide
acagatttattcatataagc

SEQ ID NO: 1867 - DNA, 20 bp, Artificial Sequence
  Synthetic oligonucleotide
agatccatagattctttctt

SEQ ID NO: 1868 - DNA, 20 bp, Artificial Sequence
  Synthetic oligonucleotide
atctgaatcagaatatctgc

SEQ ID NO: 1869 - DNA, 20 bp, Artificial Sequence
  Synthetic oligonucleotide
gaagactttatattctatgg

SEQ ID NO: 1870 - DNA, 20 bp, Artificial Sequence
  Synthetic oligonucleotide
tatccttaatattcaggtac

SEQ ID NO: 1871 - DNA, 20 bp, Artificial Sequence
  Synthetic oligonucleotide
ttattaagacatctgaaata

SEQ ID NO: 1872 - DNA, 20 bp, Artificial Sequence
  Synthetic oligonucleotide
ttaagtgactacacatggat

SEQ ID NO: 1873 - DNA, 20 bp, Artificial Sequence
  Synthetic oligonucleotide
gataatgtaacaaccctatc

SEQ ID NO: 1874 - DNA, 20 bp, Artificial Sequence
  Synthetic oligonucleotide
ctgaagcatgaattcacatt

SEQ ID NO: 1875 - DNA, 20 bp, Artificial Sequence
  Synthetic oligonucleotide
aaattccactactcatgaaa

SEQ ID NO: 1876 - DNA, 20 bp, Artificial Sequence
  Synthetic oligonucleotide
cttcagagaatatctcattt

SEQ ID NO: 1877 - DNA, 20 bp, Artificial Sequence
  Synthetic oligonucleotide
cacatcatagttttgcatga

SEQ ID NO: 1878 - DNA, 20 bp, Artificial Sequence
  Synthetic oligonucleotide
tctgacccataaagtttaaa

SEQ ID NO: 1879 - DNA, 20 bp, Artificial Sequence
  Synthetic oligonucleotide
ttggttaataataatgtatc

SEQ ID NO: 1880 - DNA, 20 bp, Artificial Sequence
  Synthetic oligonucleotide
tcacacatttgtcaaaatcc

SEQ ID NO: 1881 - DNA, 20 bp, Artificial Sequence
  Synthetic oligonucleotide
tatataattgtgtactggca

SEQ ID NO: 1882 - DNA, 20 bp, Artificial Sequence
  Synthetic oligonucleotide
tgccagtggttcagcagagg

SEQ ID NO: 1883 - DNA, 20 bp, Artificial Sequence
  Synthetic oligonucleotide
aatgtttatagcagctttat

SEQ ID NO: 1884 - DNA, 20 bp, Artificial Sequence
  Synthetic oligonucleotide
gtcactttgaatatagtttg

SEQ ID NO: 1885 - DNA, 20 bp, Artificial Sequence
  Synthetic oligonucleotide
ggctaaaatccaaaacactg

SEQ ID NO: 1886 - DNA, 20 bp, Artificial Sequence
  Synthetic oligonucleotide
aacagtatttgagaaaactt

SEQ ID NO: 1887 - DNA, 20 bp, Artificial Sequence
  Synthetic oligonucleotide
gggctacaactcaataacaa

SEQ ID NO: 1888 - DNA, 20 bp, Artificial Sequence
  Synthetic oligonucleotide
aagtccttatcatttagctc

SEQ ID NO: 1889 - DNA, 20 bp, Artificial Sequence
  Synthetic oligonucleotide
gatattcccaaagtgacagg

SEQ ID NO: 1890 - DNA, 20 bp, Artificial Sequence
  Synthetic oligonucleotide
ataatgagactttagcactc

SEQ ID NO: 1891 - DNA, 20 bp, Artificial Sequence
  Synthetic oligonucleotide
aatctaaacttccagccagg

SEQ ID NO: 1892 - DNA, 20 bp, Artificial Sequence
  Synthetic oligonucleotide
acaataatgcatgcaaatgt

SEQ ID NO: 1893 - DNA, 20 bp, Artificial Sequence
  Synthetic oligonucleotide
cactgctatttccccagcaa

SEQ ID NO: 1894 - DNA, 20 bp, Artificial Sequence
  Synthetic oligonucleotide
cttaagccccataagaacaa

SEQ ID NO: 1895 - DNA, 20 bp, Artificial Sequence
  Synthetic oligonucleotide
atctaaaacagcaacatctc

SEQ ID NO: 1896 - DNA, 20 bp, Artificial Sequence
  Synthetic oligonucleotide
tagtgattgaatgtagactt

SEQ ID NO: 1897 - DNA, 20 bp, Artificial Sequence
  Synthetic oligonucleotide
ttaggccactaagtctgagc

SEQ ID NO: 1898 - DNA, 20 bp, Artificial Sequence
  Synthetic oligonucleotide
cagctgaaatcagcctttga

SEQ ID NO: 1899 - DNA, 20 bp, Artificial Sequence
  Synthetic oligonucleotide
aatctagctaagtccataac

SEQ ID NO: 1900 - DNA, 20 bp, Artificial Sequence
  Synthetic oligonucleotide
tgcttggatatatagaagtc

SEQ ID NO: 1901 - DNA, 20 bp, Artificial Sequence
  Synthetic oligonucleotide
aggtcactttccctatacga

SEQ ID NO: 1902 - DNA, 20 bp, Artificial Sequence
  Synthetic oligonucleotide
agaaggaagattcttttctc

SEQ ID NO: 1903 - DNA, 20 bp, Artificial Sequence
  Synthetic oligonucleotide
ctaagagaggcaactgaaat

SEQ ID NO: 1904 - DNA, 20 bp, Artificial Sequence
  Synthetic oligonucleotide
ggctcgagggccactgaagg

SEQ ID NO: 1905 - DNA, 20 bp, Artificial Sequence
  Synthetic oligonucleotide
agcaagcacattgtcatgtc

SEQ ID NO: 1906 - DNA, 20 bp, Artificial Sequence
  Synthetic oligonucleotide
ggctgccaaacttttcaaaa

SEQ ID NO: 1907 - DNA, 20 bp, Artificial Sequence
  Synthetic oligonucleotide
tttgttcttgcctaaaatgc

SEQ ID NO: 1908 - DNA, 20 bp, Artificial Sequence
  Synthetic oligonucleotide
ttccttcaagtcaacttatc

SEQ ID NO: 1909 - DNA, 20 bp, Artificial Sequence
  Synthetic oligonucleotide
ccagcctacagatgactttc

SEQ ID NO: 1910 - DNA, 20 bp, Artificial Sequence
  Synthetic oligonucleotide
gccaactttagccccttcca

SEQ ID NO: 1911 - DNA, 20 bp, Artificial Sequence
  Synthetic oligonucleotide
aatgcaaaatctttaccctt

SEQ ID NO: 1912 - DNA, 20 bp, Artificial Sequence
  Synthetic oligonucleotide
ccagctcaaaaacacacact

SEQ ID NO: 1913 - DNA, 20 bp, Artificial Sequence
  Synthetic oligonucleotide
gtttgaaaaattcaagaatg

SEQ ID NO: 1914 - DNA, 20 bp, Artificial Sequence
  Synthetic oligonucleotide
atagtgtctggctcataata

SEQ ID NO: 1915 - DNA, 20 bp, Artificial Sequence
  Synthetic oligonucleotide
tcaggtcctcaaaaacacca

SEQ ID NO: 1916 - DNA, 20 bp, Artificial Sequence
  Synthetic oligonucleotide
tggctggtaccagctggtgg

SEQ ID NO: 1917 - DNA, 20 bp, Artificial Sequence
  Synthetic oligonucleotide
acaaattcatcgagctaatg

SEQ ID NO: 1918 - DNA, 20 bp, Artificial Sequence
  Synthetic oligonucleotide
agaatagcatggatttgaat

SEQ ID NO: 1919 - DNA, 20 bp, Artificial Sequence
  Synthetic oligonucleotide
cacaaacttgatcttgccac

SEQ ID NO: 1920 - DNA, 20 bp, Artificial Sequence
  Synthetic oligonucleotide
gaatgtaaagtatcttgttc

SEQ ID NO: 1921 - DNA, 20 bp, Artificial Sequence
  Synthetic oligonucleotide
tataaaatacacactggatt

SEQ ID NO: 1922 - DNA, 20 bp, Artificial Sequence
  Synthetic oligonucleotide
gaaatgtggctgcttcaaac

SEQ ID NO: 1923 - DNA, 20 bp, Artificial Sequence
  Synthetic oligonucleotide
tggagtcactagccacatgt

SEQ ID NO: 1924 - DNA, 20 bp, Artificial Sequence
  Synthetic oligonucleotide
gcatacaaatttactgaaac

SEQ ID NO: 1925 - DNA, 20 bp, Artificial Sequence
  Synthetic oligonucleotide
caagttaaaatctgcctcac

SEQ ID NO: 1926 - DNA, 20 bp, Artificial Sequence
  Synthetic oligonucleotide
ggcatgtattgattgccctc

SEQ ID NO: 1927 - DNA, 20 bp, Artificial Sequence
  Synthetic oligonucleotide
agtaaaagcagtggctgacg

SEQ ID NO: 1928 - DNA, 20 bp, Artificial Sequence
  Synthetic oligonucleotide
cacctgccacaggacaaatg

SEQ ID NO: 1929 - DNA, 20 bp, Artificial Sequence
  Synthetic oligonucleotide
ttgccccaattaggccaata

SEQ ID NO: 1930 - DNA, 20 bp, Artificial Sequence
  Synthetic oligonucleotide
aagggcttaaattccactgg

SEQ ID NO: 1931 - DNA, 20 bp, Artificial Sequence
  Synthetic oligonucleotide
gtactttacatgtgcagcac

SEQ ID NO: 1932 - DNA, 20 bp, Artificial Sequence
  Synthetic oligonucleotide
aatatatccaaaatgttatt

SEQ ID NO: 1933 - DNA, 20 bp, Artificial Sequence
  Synthetic oligonucleotide
gcagcatccaacagaaatag

SEQ ID NO: 1934 - DNA, 20 bp, Artificial Sequence
  Synthetic oligonucleotide
gagactgaacacacgcaaac

SEQ ID NO: 1935 - DNA, 20 bp, Artificial Sequence
  Synthetic oligonucleotide
gttctctgggatagtgagaa

SEQ ID NO: 1936 - DNA, 20 bp, Artificial Sequence
  Synthetic oligonucleotide
gagaaacccagccagctaat

SEQ ID NO: 1937 - DNA, 20 bp, Artificial Sequence
  Synthetic oligonucleotide
ggaagatctgcctgagattc

SEQ ID NO: 1938 - DNA, 20 bp, Artificial Sequence
  Synthetic oligonucleotide
tacagcatccagctcagtgc

SEQ ID NO: 1939 - DNA, 20 bp, Artificial Sequence
  Synthetic oligonucleotide
cccagtttagaacaatacaa

SEQ ID NO: 1940 - DNA, 20 bp, Artificial Sequence
  Synthetic oligonucleotide
gtagccattgcccaacacag

SEQ ID NO: 1941 - DNA, 20 bp, Artificial Sequence
  Synthetic oligonucleotide
caccacaagtcccagtaggg

SEQ ID NO: 1942 - DNA, 20 bp, Artificial Sequence
  Synthetic oligonucleotide
taaaccaaagtgtgcatatg

SEQ ID NO: 1943 - DNA, 20 bp, Artificial Sequence
  Synthetic oligonucleotide
aaggacttaccaatcttgac

SEQ ID NO: 1944 - DNA, 20 bp, Artificial Sequence
  Synthetic oligonucleotide
acctaacaatttggagagtc

SEQ ID NO: 1945 - DNA, 20 bp, Artificial Sequence
  Synthetic oligonucleotide
ttacaagaccaaagggtgcc

SEQ ID NO: 1946 - DNA, 20 bp, Artificial Sequence
  Synthetic oligonucleotide
aaatcaaccttcaagacatc

SEQ ID NO: 1947 - DNA, 20 bp, Artificial Sequence
  Synthetic oligonucleotide
aaaaatatgtctaccacatc

SEQ ID NO: 1948 - DNA, 20 bp, Artificial Sequence
  Synthetic oligonucleotide
aagttctagctatgacagaa

SEQ ID NO: 1949 - DNA, 20 bp, Artificial Sequence
  Synthetic oligonucleotide
agcctgcagaactatgagcc

SEQ ID NO: 1950 - DNA, 20 bp, Artificial Sequence
  Synthetic oligonucleotide
attggaagcttgctgaggcc

SEQ ID NO: 1951 - DNA, 20 bp, Artificial Sequence
  Synthetic oligonucleotide
ctgccttccgccatgattgg

SEQ ID NO: 1952 - DNA, 20 bp, Artificial Sequence
  Synthetic oligonucleotide
cgagacagtgagttcttgtg

SEQ ID NO: 1953 - DNA, 20 bp, Artificial Sequence
  Synthetic oligonucleotide
ctggcccttcaccaaatcag

SEQ ID NO: 1954 - DNA, 20 bp, Artificial Sequence
  Synthetic oligonucleotide
ggtcagatttattagtacaa

SEQ ID NO: 1955 - DNA, 20 bp, Artificial Sequence
  Synthetic oligonucleotide
atcatacctgaagaaactgc

SEQ ID NO: 1956 - DNA, 20 bp, Artificial Sequence
  Synthetic oligonucleotide
atacagagctttgagaaagg

SEQ ID NO: 1957 - DNA, 20 bp, Artificial Sequence
  Synthetic oligonucleotide
tgtaacagtgagagtcatct

SEQ ID NO: 1958 - DNA, 20 bp, Artificial Sequence
  Synthetic oligonucleotide
tctgagtctttacacagtat

SEQ ID NO: 1959 - DNA, 20 bp, Artificial Sequence
  Synthetic oligonucleotide
ttcatcaaggaaagcattta

SEQ ID NO: 1960 - DNA, 20 bp, Artificial Sequence
  Synthetic oligonucleotide
tggagatgtggactgaactg

SEQ ID NO: 1961 - DNA, 20 bp, Artificial Sequence
  Synthetic oligonucleotide
cctgggccgcagtggctgca

SEQ ID NO: 1962 - DNA, 20 bp, Artificial Sequence
  Synthetic oligonucleotide
gttttgtctcaggtctcacc

SEQ ID NO: 1963 - DNA, 20 bp, Artificial Sequence
  Synthetic oligonucleotide
ccagaccagggatttgtttt

SEQ ID NO: 1964 - DNA, 20 bp, Artificial Sequence
  Synthetic oligonucleotide
ctcattataaagttgtttga

SEQ ID NO: 1965 - DNA, 20 bp, Artificial Sequence
  Synthetic oligonucleotide
tgtactatgaaagtttgtca

SEQ ID NO: 1966 - DNA, 20 bp, Artificial Sequence
  Synthetic oligonucleotide
aatgatattggaataatctg

SEQ ID NO: 1967 - DNA, 20 bp, Artificial Sequence
  Synthetic oligonucleotide
ctttggaaaagtttgaatga

SEQ ID NO: 1968 - DNA, 20 bp, Artificial Sequence
  Synthetic oligonucleotide
cagcctcataaaataagctg

SEQ ID NO: 1969 - DNA, 20 bp, Artificial Sequence
  Synthetic oligonucleotide
tactgagaatagtgtttcac

SEQ ID NO: 1970 - DNA, 20 bp, Artificial Sequence
  Synthetic oligonucleotide
aagacatccttatcttttgc

SEQ ID NO: 1971 - DNA, 20 bp, Artificial Sequence
  Synthetic oligonucleotide
ttccaatatttgtaccctca

SEQ ID NO: 1972 - DNA, 20 bp, Artificial Sequence
  Synthetic oligonucleotide
tacaatggcctttctaaacc

SEQ ID NO: 1973 - DNA, 20 bp, Artificial Sequence
  Synthetic oligonucleotide
agatctttactttcattaca

SEQ ID NO: 1974 - DNA, 20 bp, Artificial Sequence
  Synthetic oligonucleotide
tatgcaaattgcatacattt

SEQ ID NO: 1975 - DNA, 20 bp, Artificial Sequence
  Synthetic oligonucleotide
tttccagatattttcccata

SEQ ID NO: 1976 - DNA, 20 bp, Artificial Sequence
  Synthetic oligonucleotide
gtgtatttcaccacaatttt

SEQ ID NO: 1977 - DNA, 20 bp, Artificial Sequence
  Synthetic oligonucleotide
tgtctttgaacatgatcttc

SEQ ID NO: 1978 - DNA, 20 bp, Artificial Sequence
  Synthetic oligonucleotide
gcatgactaattaaaacatc

SEQ ID NO: 1979 - DNA, 20 bp, Artificial Sequence
  Synthetic oligonucleotide
cagagcaagtggcagggctg

SEQ ID NO: 1980 - DNA, 20 bp, Artificial Sequence
  Synthetic oligonucleotide
cagagagagtaaaaattgtt

SEQ ID NO: 1981 - DNA, 20 bp, Artificial Sequence
  Synthetic oligonucleotide
cagcagaaagcagttaaatt

SEQ ID NO: 1982 - DNA, 20 bp, Artificial Sequence
  Synthetic oligonucleotide
cagtaatggtgagggtgatg

SEQ ID NO: 1983 - DNA, 20 bp, Artificial Sequence
  Synthetic oligonucleotide
ggtccccatttcctacagta

SEQ ID NO: 1984 - DNA, 20 bp, Artificial Sequence
  Synthetic oligonucleotide
acacctgagcatatcagttt

SEQ ID NO: 1985 - DNA, 20 bp, Artificial Sequence
  Synthetic oligonucleotide
cagaaaatcctagtgctgcc

SEQ ID NO: 1986 - DNA, 20 bp, Artificial Sequence
  Synthetic oligonucleotide
ataaaatacaaaggttttcc

SEQ ID NO: 1987 - DNA, 20 bp, Artificial Sequence
  Synthetic oligonucleotide
tccaaattgacttaaaccac

SEQ ID NO: 1988 - DNA, 20 bp, Artificial Sequence
  Synthetic oligonucleotide
ttgaaaacatccttgggata

SEQ ID NO: 1989 - DNA, 20 bp, Artificial Sequence
  Synthetic oligonucleotide
caggctggatttgggccacg

SEQ ID NO: 1990 - DNA, 20 bp, Artificial Sequence
  Synthetic oligonucleotide
gccacagataatgcataaat

SEQ ID NO: 1991 - DNA, 20 bp, Artificial Sequence
  Synthetic oligonucleotide
ctgggttgaggccacaaata

SEQ ID NO: 1992 - DNA, 20 bp, Artificial Sequence
  Synthetic oligonucleotide
gtttgtgtacttataatccc

SEQ ID NO: 1993 - DNA, 20 bp, Artificial Sequence
  Synthetic oligonucleotide
gacaaaatgacacacatcct

SEQ ID NO: 1994 - DNA, 20 bp, Artificial Sequence
  Synthetic oligonucleotide
tttcacacaattgataactt

SEQ ID NO: 1995 - DNA, 20 bp, Artificial Sequence
  Synthetic oligonucleotide
caggccaacacagaaagctg

SEQ ID NO: 1996 - DNA, 20 bp, Artificial Sequence
  Synthetic oligonucleotide
agaaacccacctctaatacc

SEQ ID NO: 1997 - DNA, 20 bp, Artificial Sequence
  Synthetic oligonucleotide
gccacactttccattctagt

SEQ ID NO: 1998 - DNA, 20 bp, Artificial Sequence
  Synthetic oligonucleotide
tggttaccagctcaagccac

SEQ ID NO: 1999 - DNA, 20 bp, Artificial Sequence
  Synthetic oligonucleotide
caggtctagaggcctatccc

SEQ ID NO: 2000 - DNA, 20 bp, Artificial Sequence
  Synthetic oligonucleotide
tcttcaaagaacccagcacc

SEQ ID NO: 2001 - DNA, 20 bp, Artificial Sequence
  Synthetic oligonucleotide
agatggagagaaagactctg

SEQ ID NO: 2002 - DNA, 20 bp, Artificial Sequence
  Synthetic oligonucleotide
cccacagtgacagtgactca

SEQ ID NO: 2003 - DNA, 20 bp, Artificial Sequence
  Synthetic oligonucleotide
cttagaagttttgggaaggt

SEQ ID NO: 2004 - DNA, 20 bp, Artificial Sequence
  Synthetic oligonucleotide
atggtccctatccaagccca

SEQ ID NO: 2005 - DNA, 20 bp, Artificial Sequence
  Synthetic oligonucleotide
atgggcaaccattctcttcc

SEQ ID NO: 2006 - DNA, 20 bp, Artificial Sequence
  Synthetic oligonucleotide
gttggatgtctacttaaacg

SEQ ID NO: 2007 - DNA, 20 bp, Artificial Sequence
  Synthetic oligonucleotide
gaccacatgttcagctaaga

SEQ ID NO: 2008 - DNA, 20 bp, Artificial Sequence
  Synthetic oligonucleotide
aaacagaggcagtggtgctg

SEQ ID NO: 2009 - DNA, 20 bp, Artificial Sequence
  Synthetic oligonucleotide
ccaaaaaggaggtcaatgca

SEQ ID NO: 2010 - DNA, 20 bp, Artificial Sequence
  Synthetic oligonucleotide
gtatccccaagagaaggctc

SEQ ID NO: 2011 - DNA, 20 bp, Artificial Sequence
  Synthetic oligonucleotide
tcaaatgaagccaaaacctc

SEQ ID NO: 2012 - DNA, 20 bp, Artificial Sequence
  Synthetic oligonucleotide
cactttctagagattttaac

SEQ ID NO: 2013 - DNA, 20 bp, Artificial Sequence
  Synthetic oligonucleotide
tcagatcttgcatgtctgcg

SEQ ID NO: 2014 - DNA, 20 bp, Artificial Sequence
  Synthetic oligonucleotide
ccgcaagtgagcgagacaca

SEQ ID NO: 2015 - DNA, 20 bp, Artificial Sequence
  Synthetic oligonucleotide
ccacattctttagtcaactc

SEQ ID NO: 2016 - DNA, 20 bp, Artificial Sequence
  Synthetic oligonucleotide
cagaaaacatttcctcagac

SEQ ID NO: 2017 - DNA, 20 bp, Artificial Sequence
  Synthetic oligonucleotide
accagttttctagccgatct

SEQ ID NO: 2018 - DNA, 20 bp, Artificial Sequence
  Synthetic oligonucleotide
aggaaaagcttctttcatcc

SEQ ID NO: 2019 - DNA, 20 bp, Artificial Sequence
  Synthetic oligonucleotide
gctttcgagaaagaaaggaa

SEQ ID NO: 2020 - DNA, 20 bp, Artificial Sequence
  Synthetic oligonucleotide
tggatgaaggtaaaagtgca

SEQ ID NO: 2021 - DNA, 20 bp, Artificial Sequence
  Synthetic oligonucleotide
tcactatagggccttgcaca

SEQ ID NO: 2022 - DNA, 20 bp, Artificial Sequence
  Synthetic oligonucleotide
agctggtgcaacatgctcac

SEQ ID NO: 2023 - DNA, 20 bp, Artificial Sequence
  Synthetic oligonucleotide
gcattctcatgtagagttgc

SEQ ID NO: 2024 - DNA, 20 bp, Artificial Sequence
  Synthetic oligonucleotide
gatatgaatagacaggcatt

SEQ ID NO: 2025 - DNA, 20 bp, Artificial Sequence
  Synthetic oligonucleotide
attcccagaacttaagcttc

SEQ ID NO: 2026 - DNA, 20 bp, Artificial Sequence
  Synthetic oligonucleotide
attccatcattctttgatgg

SEQ ID NO: 2027 - DNA, 20 bp, Artificial Sequence
  Synthetic oligonucleotide
tgcacaaggaataagtgaat

SEQ ID NO: 2028 - DNA, 20 bp, Artificial Sequence
  Synthetic oligonucleotide
agaagggcttgaactacatg

SEQ ID NO: 2029 - DNA, 20 bp, Artificial Sequence
  Synthetic oligonucleotide
gagcccagatatgcagaaca

SEQ ID NO: 2030 - DNA, 20 bp, Artificial Sequence
  Synthetic oligonucleotide
aaatgacaagcatctgagcc

SEQ ID NO: 2031 - DNA, 20 bp, Artificial Sequence
  Synthetic oligonucleotide
atttataccactaggaggca

SEQ ID NO: 2032 - DNA, 20 bp, Artificial Sequence
  Synthetic oligonucleotide
ttcagtgacattaagaaaag

SEQ ID NO: 2033 - DNA, 20 bp, Artificial Sequence
  Synthetic oligonucleotide
atcttaagtttacagttcag

SEQ ID NO: 2034 - DNA, 20 bp, Artificial Sequence
  Synthetic oligonucleotide
gcatgaaatttacaattttt

SEQ ID NO: 2035 - DNA, 20 bp, Artificial Sequence
  Synthetic oligonucleotide
tcctgccaataaattaagaa

SEQ ID NO: 2036 - DNA, 20 bp, Artificial Sequence
  Synthetic oligonucleotide
gaagtcagcccgcctctcac

SEQ ID NO: 2037 - DNA, 20 bp, Artificial Sequence
  Synthetic oligonucleotide
gtgtccctcagtaaaatctc

SEQ ID NO: 2038 - DNA, 20 bp, Artificial Sequence
  Synthetic oligonucleotide
atgaccctggccaccaactc

SEQ ID NO: 2039 - DNA, 20 bp, Artificial Sequence
  Synthetic oligonucleotide
cagaatcagagagcaagcag

SEQ ID NO: 2040 - DNA, 20 bp, Artificial Sequence
  Synthetic oligonucleotide
ccttaaaatccacagggaag

SEQ ID NO: 2041 - DNA, 20 bp, Artificial Sequence
  Synthetic oligonucleotide
tccccatcactaagccttac

SEQ ID NO: 2042 - DNA, 20 bp, Artificial Sequence
  Synthetic oligonucleotide
taacacctcaccctacaggc

SEQ ID NO: 2043 - DNA, 20 bp, Artificial Sequence
  Synthetic oligonucleotide
acaccatactaagtttctga

SEQ ID NO: 2044 - DNA, 20 bp, Artificial Sequence
  Synthetic oligonucleotide
cttgtcaatgcacactttaa

SEQ ID NO: 2045 - DNA, 20 bp, Artificial Sequence
  Synthetic oligonucleotide
tctagttcaaatgatgtctg

SEQ ID NO: 2046 - DNA, 20 bp, Artificial Sequence
  Synthetic oligonucleotide
aataaagacagagtctctag

SEQ ID NO: 2047 - DNA, 20 bp, Artificial Sequence
  Synthetic oligonucleotide
caaaatgaagatctctgaat

SEQ ID NO: 2048 - DNA, 20 bp, Artificial Sequence
  Synthetic oligonucleotide
agctttgtggctttgttcag

SEQ ID NO: 2049 - DNA, 20 bp, Artificial Sequence
  Synthetic oligonucleotide
tgaatgacatgtacaagtaa

SEQ ID NO: 2050 - DNA, 20 bp, Artificial Sequence
  Synthetic oligonucleotide
tgtgtaaggactatatactc

SEQ ID NO: 2051 - DNA, 20 bp, Artificial Sequence
  Synthetic oligonucleotide
ttcagcacagtaacatactg

SEQ ID NO: 2052 - DNA, 20 bp, Artificial Sequence
  Synthetic oligonucleotide
agatgtgttacaattgccta

SEQ ID NO: 2053 - DNA, 20 bp, Artificial Sequence
  Synthetic oligonucleotide
tttacatcctgaaaggtatt

SEQ ID NO: 2054 - DNA, 20 bp, Artificial Sequence
  Synthetic oligonucleotide
atatgtacttattaaaccta

SEQ ID NO: 2055 - DNA, 20 bp, Artificial Sequence
  Synthetic oligonucleotide
acaaaaggaagcctctaggc

SEQ ID NO: 2056 - DNA, 20 bp, Artificial Sequence
  Synthetic oligonucleotide
ccaagtgtttgaattctgca

SEQ ID NO: 2057 - DNA, 20 bp, Artificial Sequence
  Synthetic oligonucleotide
caggttgatgtttctaattc

SEQ ID NO: 2058 - DNA, 20 bp, Artificial Sequence
  Synthetic oligonucleotide
ctacagctgaaagaacaggt

SEQ ID NO: 2059 - DNA, 20 bp, Artificial Sequence
  Synthetic oligonucleotide
atgttccaagccagagagct

SEQ ID NO: 2060 - DNA, 20 bp, Artificial Sequence
  Synthetic oligonucleotide
ggtgtggagaacaactcagc

SEQ ID NO: 2061 - DNA, 20 bp, Artificial Sequence
  Synthetic oligonucleotide
gggaatttggaaagccccag

SEQ ID NO: 2062 - DNA, 20 bp, Artificial Sequence
  Synthetic oligonucleotide
cagccgcaggagctggatgg

SEQ ID NO: 2063 - DNA, 20 bp, Artificial Sequence
  Synthetic oligonucleotide
ggagccaagcagggtcagcc

SEQ ID NO: 2064 - DNA, 20 bp, Artificial Sequence
  Synthetic oligonucleotide
ggagagaaaaacagggcact

SEQ ID NO: 2065 - DNA, 20 bp, Artificial Sequence
  Synthetic oligonucleotide
tatcccacctcagtgggaga

SEQ ID NO: 2066 - DNA, 20 bp, Artificial Sequence
  Synthetic oligonucleotide
tctgaatcaatgaaaagcag

SEQ ID NO: 2067 - DNA, 20 bp, Artificial Sequence
  Synthetic oligonucleotide
catcacaatttttaaaaatg

SEQ ID NO: 2068 - DNA, 20 bp, Artificial Sequence
  Synthetic oligonucleotide
gtatttttaaaacacatata

SEQ ID NO: 2069 - DNA, 20 bp, Artificial Sequence
  Synthetic oligonucleotide
cttaatatacatatgaatac

SEQ ID NO: 2070 - DNA, 20 bp, Artificial Sequence
  Synthetic oligonucleotide
caaatatcacagagacagtc

SEQ ID NO: 2071 - DNA, 20 bp, Artificial Sequence
  Synthetic oligonucleotide
gtacagcaaccttattttaa

SEQ ID NO: 2072 - DNA, 20 bp, Artificial Sequence
  Synthetic oligonucleotide
ttaaatcctgggaatggcac

SEQ ID NO: 2073 - DNA, 20 bp, Artificial Sequence
  Synthetic oligonucleotide
ctaatgttgatgggtattta

SEQ ID NO: 2074 - DNA, 20 bp, Artificial Sequence
  Synthetic oligonucleotide
catggttatgtgtatctgca

SEQ ID NO: 2075 - DNA, 20 bp, Artificial Sequence
  Synthetic oligonucleotide
ttcacttgatgtgaaatgaa

SEQ ID NO: 2076 - DNA, 20 bp, Artificial Sequence
  Synthetic oligonucleotide
tgccagggacacaacttgct

SEQ ID NO: 2077 - DNA, 20 bp, Artificial Sequence
  Synthetic oligonucleotide
atggcattcagtactaacag

SEQ ID NO: 2078 - DNA, 20 bp, Artificial Sequence
  Synthetic oligonucleotide
ttttcctcagagagaatggc

SEQ ID NO: 2079 - DNA, 20 bp, Artificial Sequence
  Synthetic oligonucleotide
agtcacaatcagggaagcct

SEQ ID NO: 2080 - DNA, 20 bp, Artificial Sequence
  Synthetic oligonucleotide
agtaatcattccaccttctc

SEQ ID NO: 2081 - DNA, 20 bp, Artificial Sequence
  Synthetic oligonucleotide
cagtgttaagcaaacagtaa

SEQ ID NO: 2082 - DNA, 20 bp, Artificial Sequence
  Synthetic oligonucleotide
atacacacatcttctaagca

SEQ ID NO: 2083 - DNA, 20 bp, Artificial Sequence
  Synthetic oligonucleotide
tcaagtttgctgaaagctga

SEQ ID NO: 2084 - DNA, 20 bp, Artificial Sequence
  Synthetic oligonucleotide
atagagattttcatatcaag

SEQ ID NO: 2085 - DNA, 20 bp, Artificial Sequence
  Synthetic oligonucleotide
acagggaggtctcaggaatc

SEQ ID NO: 2086 - DNA, 20 bp, Artificial Sequence
  Synthetic oligonucleotide
tttaagaccttggaggcatt

SEQ ID NO: 2087 - DNA, 20 bp, Artificial Sequence
  Synthetic oligonucleotide
agggatggtgctcattgtct

SEQ ID NO: 2088 - DNA, 20 bp, Artificial Sequence
  Synthetic oligonucleotide
gccggatcccttttctgggc

SEQ ID NO: 2089 - DNA, 20 bp, Artificial Sequence
  Synthetic oligonucleotide
tgatcacctcgactgaaaac

SEQ ID NO: 2090 - DNA, 20 bp, Artificial Sequence
  Synthetic oligonucleotide
gtgccaccttccaacacaca

SEQ ID NO: 2091 - DNA, 20 bp, Artificial Sequence
  Synthetic oligonucleotide
cagacaggtgtatttggtgg

SEQ ID NO: 2092 - DNA, 20 bp, Artificial Sequence
  Synthetic oligonucleotide
actttgcaaaatttagccca

SEQ ID NO: 2093 - DNA, 20 bp, Artificial Sequence
  Synthetic oligonucleotide
tcccattcccacgagaattt

SEQ ID NO: 2094 - DNA, 20 bp, Artificial Sequence
  Synthetic oligonucleotide
gccttcaagccagagccctc

SEQ ID NO: 2095 - DNA, 20 bp, Artificial Sequence
  Synthetic oligonucleotide
gaccaagagttcagggcctt

SEQ ID NO: 2096 - DNA, 20 bp, Artificial Sequence
  Synthetic oligonucleotide
gtaatgggaaagccaagtct

SEQ ID NO: 2097 - DNA, 20 bp, Artificial Sequence
  Synthetic oligonucleotide
ttgccagccatgttttcctg

SEQ ID NO: 2098 - DNA, 20 bp, Artificial Sequence
  Synthetic oligonucleotide
agggcatccatcccctgcca

SEQ ID NO: 2099 - DNA, 20 bp, Artificial Sequence
  Synthetic oligonucleotide
tcactggagcaagcaaaaca

SEQ ID NO: 2100 - DNA, 20 bp, Artificial Sequence
  Synthetic oligonucleotide
ggtcatagaaaataaacttg

SEQ ID NO: 2101 - DNA, 20 bp, Artificial Sequence
  Synthetic oligonucleotide
agtgttgagaccctgaacac

SEQ ID NO: 2102 - DNA, 20 bp, Artificial Sequence
  Synthetic oligonucleotide
agagaaaactgcccattttt

SEQ ID NO: 2103 - DNA, 20 bp, Artificial Sequence
  Synthetic oligonucleotide
agatcatggaacctacagct

SEQ ID NO: 2104 - DNA, 20 bp, Artificial Sequence
  Synthetic oligonucleotide
ggacatgggaaggaaagatc

SEQ ID NO: 2105 - DNA, 20 bp, Artificial Sequence
  Synthetic oligonucleotide
caacaactacctgggtcagc

SEQ ID NO: 2106 - DNA, 20 bp, Artificial Sequence
  Synthetic oligonucleotide
aggcatttgcctatctatcc

SEQ ID NO: 2107 - DNA, 20 bp, Artificial Sequence
  Synthetic oligonucleotide
ccaacaaaagcactcactac

SEQ ID NO: 2108 - DNA, 20 bp, Artificial Sequence
  Synthetic oligonucleotide
tgaaatctgggcctcaaacc

SEQ ID NO: 2109 - DNA, 20 bp, Artificial Sequence
  Synthetic oligonucleotide
gaaaccctttcttcagacca

SEQ ID NO: 2110 - DNA, 20 bp, Artificial Sequence
  Synthetic oligonucleotide
tcaaaacagcaagtgctgaa

SEQ ID NO: 2111 - DNA, 20 bp, Artificial Sequence
  Synthetic oligonucleotide
aaccctaaaggatcacatta

SEQ ID NO: 2112 - DNA, 20 bp, Artificial Sequence
  Synthetic oligonucleotide
caaagagccgtgtggcaggg

SEQ ID NO: 2113 - DNA, 20 bp, Artificial Sequence
  Synthetic oligonucleotide
gaccagccgtgggaccccaa

SEQ ID NO: 2114 - DNA, 20 bp, Artificial Sequence
  Synthetic oligonucleotide
ccacaggaagggcgatggta

SEQ ID NO: 2115 - DNA, 20 bp, Artificial Sequence
  Synthetic oligonucleotide
gcaggaaaggacctggcctc

SEQ ID NO: 2116 - DNA, 20 bp, Artificial Sequence
  Synthetic oligonucleotide
ttagggagctgacaccctag

SEQ ID NO: 2117 - DNA, 20 bp, Artificial Sequence
  Synthetic oligonucleotide
caattcagtgcagaattcaa

SEQ ID NO: 2118 - DNA, 20 bp, Artificial Sequence
  Synthetic oligonucleotide
tctgagtttactttgggcca

SEQ ID NO: 2119 - DNA, 20 bp, Artificial Sequence
  Synthetic oligonucleotide
catgatgaccatgtgaaaga

SEQ ID NO: 2120 - DNA, 20 bp, Artificial Sequence
  Synthetic oligonucleotide
ctgaatgcttacaccaagag

SEQ ID NO: 2121 - DNA, 20 bp, Artificial Sequence
  Synthetic oligonucleotide
ccaattttctatgagctttg

SEQ ID NO: 2122 - DNA, 20 bp, Artificial Sequence
  Synthetic oligonucleotide
cttttatgtataaaataaga

SEQ ID NO: 2123 - DNA, 20 bp, Artificial Sequence
  Synthetic oligonucleotide
ccaggtacatcttcaatagc

SEQ ID NO: 2124 - DNA, 20 bp, Artificial Sequence
  Synthetic oligonucleotide
gtacaattgcttcaactaga

SEQ ID NO: 2125 - DNA, 20 bp, Artificial Sequence
  Synthetic oligonucleotide
acatttttggatgagggcat

SEQ ID NO: 2126 - DNA, 20 bp, Artificial Sequence
  Synthetic oligonucleotide
aaagccaaaggttatatctc

SEQ ID NO: 2127 - DNA, 20 bp, Artificial Sequence
  Synthetic oligonucleotide
aatgcttgtggttccaaagc

SEQ ID NO: 2128 - DNA, 20 bp, Artificial Sequence
  Synthetic oligonucleotide
tgtaaaagtttaacagcctc

SEQ ID NO: 2129 - DNA, 20 bp, Artificial Sequence
  Synthetic oligonucleotide
cataaccttttcccacctga

SEQ ID NO: 2130 - DNA, 20 bp, Artificial Sequence
  Synthetic oligonucleotide
cagttctttgcacaaagctg

SEQ ID NO: 2131 - DNA, 20 bp, Artificial Sequence
  Synthetic oligonucleotide
caagattgtctggaaagctc

SEQ ID NO: 2132 - DNA, 20 bp, Artificial Sequence
  Synthetic oligonucleotide
tcgcattcagtaagcagagc

SEQ ID NO: 2133 - DNA, 20 bp, Artificial Sequence
  Synthetic oligonucleotide
aaaccagttttcttactgac

SEQ ID NO: 2134 - DNA, 20 bp, Artificial Sequence
  Synthetic oligonucleotide
cggtgtcacacagataaact

SEQ ID NO: 2135 - DNA, 20 bp, Artificial Sequence
  Synthetic oligonucleotide
ttaactctcacccagtgtcc

SEQ ID NO: 2136 - DNA, 20 bp, Artificial Sequence
  Synthetic oligonucleotide
gtactaaacatagcccaggg

SEQ ID NO: 2137 - DNA, 20 bp, Artificial Sequence
  Synthetic oligonucleotide
aaatactcaccaaactgccc

SEQ ID NO: 2138 - DNA, 20 bp, Artificial Sequence
  Synthetic oligonucleotide
gtgaccagctctcggtgtgt

SEQ ID NO: 2139 - DNA, 20 bp, Artificial Sequence
  Synthetic oligonucleotide
gatttggtttgtccaaactg

SEQ ID NO: 2140 - DNA, 20 bp, Artificial Sequence
  Synthetic oligonucleotide
gtcagaaaagccagatttac

SEQ ID NO: 2141 - DNA, 20 bp, Artificial Sequence
  Synthetic oligonucleotide
gcaactggcaggccacgccc

SEQ ID NO: 2142 - DNA, 20 bp, Artificial Sequence
  Synthetic oligonucleotide
agttgtccaccctctgcaac

SEQ ID NO: 2143 - DNA, 20 bp, Artificial Sequence
  Synthetic oligonucleotide
tgtcaaaggtgagggactct

SEQ ID NO: 2144 - DNA, 20 bp, Artificial Sequence
  Synthetic oligonucleotide
cacactatacacatttttaa

SEQ ID NO: 2145 - DNA, 20 bp, Artificial Sequence
  Synthetic oligonucleotide
acacactatacacattttta

SEQ ID NO: 2146 - DNA, 20 bp, Artificial Sequence
  Synthetic oligonucleotide
tacacactatacacattttt

SEQ ID NO: 2147 - DNA, 20 bp, Artificial Sequence
  Synthetic oligonucleotide
ggtacacactatacacattt

SEQ ID NO: 2148 - DNA, 20 bp, Artificial Sequence
  Synthetic oligonucleotide
aggtacacactatacacatt

SEQ ID NO: 2149 - DNA, 20 bp, Artificial Sequence
  Synthetic oligonucleotide
caggtacacactatacacat

SEQ ID NO: 2150 - DNA, 20 bp, Artificial Sequence
  Synthetic oligonucleotide
gcaggtacacactatacaca

SEQ ID NO: 2151 - DNA, 20 bp, Artificial Sequence
  Synthetic oligonucleotide
agcaggtacacactatacac

SEQ ID NO: 2152 - DNA, 20 bp, Artificial Sequence
  Synthetic oligonucleotide
cagcaggtacacactataca

SEQ ID NO: 2153 - DNA, 20 bp, Artificial Sequence
  Synthetic oligonucleotide
ccagcaggtacacactatac

SEQ ID NO: 2154 - DNA, 20 bp, Artificial Sequence
  Synthetic oligonucleotide
accagcaggtacacactata

SEQ ID NO: 2155 - DNA, 20 bp, Artificial Sequence
  Synthetic oligonucleotide
gaccagcaggtacacactat

SEQ ID NO: 2156 - DNA, 20 bp, Artificial Sequence
  Synthetic oligonucleotide
agaccagcaggtacacacta

SEQ ID NO: 2157 - DNA, 20 bp, Artificial Sequence
  Synthetic oligonucleotide
aagaccagcaggtacacact

SEQ ID NO: 2158 - DNA, 20 bp, Artificial Sequence
  Synthetic oligonucleotide
taagaccagcaggtacacac

SEQ ID NO: 2159 - DNA, 20 bp, Artificial Sequence
  Synthetic oligonucleotide
gtaagaccagcaggtacaca

SEQ ID NO: 2160 - DNA, 20 bp, Artificial Sequence
  Synthetic oligonucleotide
agtaagaccagcaggtacac

SEQ ID NO: 2161 - DNA, 20 bp, Artificial Sequence
  Synthetic oligonucleotide
cagtaagaccagcaggtaca

SEQ ID NO: 2162 - DNA, 20 bp, Artificial Sequence
  Synthetic oligonucleotide
acagtaagaccagcaggtac

SEQ ID NO: 2163 - DNA, 20 bp, Artificial Sequence
  Synthetic oligonucleotide
tacagtaagaccagcaggta

SEQ ID NO: 2164 - DNA, 20 bp, Artificial Sequence
  Synthetic oligonucleotide
atacagtaagaccagcaggt

SEQ ID NO: 2165 - DNA, 20 bp, Artificial Sequence
  Synthetic oligonucleotide
catacagtaagaccagcagg

SEQ ID NO: 2166 - DNA, 20 bp, Artificial Sequence
  Synthetic oligonucleotide
acatacagtaagaccagcag

SEQ ID NO: 2167 - DNA, 20 bp, Artificial Sequence
  Synthetic oligonucleotide
cacatacagtaagaccagca

SEQ ID NO: 2168 - DNA, 20 bp, Artificial Sequence
  Synthetic oligonucleotide
gcacatacagtaagaccagc

SEQ ID NO: 2169 - DNA, 20 bp, Artificial Sequence
  Synthetic oligonucleotide
tgcacatacagtaagaccag

SEQ ID NO: 2170 - DNA, 20 bp, Artificial Sequence
  Synthetic oligonucleotide
ttgcacatacagtaagacca

SEQ ID NO: 2171 - DNA, 20 bp, Artificial Sequence
  Synthetic oligonucleotide
gttgcacatacagtaagacc

SEQ ID NO: 2172 - DNA, 20 bp, Artificial Sequence
  Synthetic oligonucleotide
agttgcacatacagtaagac

SEQ ID NO: 2173 - DNA, 20 bp, Artificial Sequence
  Synthetic oligonucleotide
tagttgcacatacagtaaga

SEQ ID NO: 2174 - DNA, 20 bp, Artificial Sequence
  Synthetic oligonucleotide
agccaaaaatttacaaccca

SEQ ID NO: 2175 - DNA, 20 bp, Artificial Sequence
  Synthetic oligonucleotide
cagccaaaaatttacaaccc

SEQ ID NO: 2176 - DNA, 20 bp, Artificial Sequence
  Synthetic oligonucleotide
ccagccaaaaatttacaacc

SEQ ID NO: 2177 - DNA, 20 bp, Artificial Sequence
  Synthetic oligonucleotide
gccagccaaaaatttacaac

SEQ ID NO: 2178 - DNA, 20 bp, Artificial Sequence
  Synthetic oligonucleotide
agccagccaaaaatttacaa

SEQ ID NO: 2179 - DNA, 20 bp, Artificial Sequence
  Synthetic oligonucleotide
cagccagccaaaaatttaca

SEQ ID NO: 2180 - DNA, 20 bp, Artificial Sequence
  Synthetic oligonucleotide
acagccagccaaaaatttac

SEQ ID NO: 2181 - DNA, 20 bp, Artificial Sequence
  Synthetic oligonucleotide
cacagccagccaaaaattta

SEQ ID NO: 2182 - DNA, 20 bp, Artificial Sequence
  Synthetic oligonucleotide
gcacagccagccaaaaattt

SEQ ID NO: 2183 - DNA, 20 bp, Artificial Sequence
  Synthetic oligonucleotide
agcacagccagccaaaaatt

SEQ ID NO: 2184 - DNA, 20 bp, Artificial Sequence
  Synthetic oligonucleotide
cagcacagccagccaaaaat

SEQ ID NO: 2185 - DNA, 20 bp, Artificial Sequence
  Synthetic oligonucleotide
tcagcacagccagccaaaaa

SEQ ID NO: 2186 - DNA, 20 bp, Artificial Sequence
  Synthetic oligonucleotide
atcagcacagccagccaaaa

SEQ ID NO: 2187 - DNA, 20 bp, Artificial Sequence
  Synthetic oligonucleotide
tatcagcacagccagccaaa

SEQ ID NO: 2188 - DNA, 20 bp, Artificial Sequence
  Synthetic oligonucleotide
ttatcagcacagccagccaa

SEQ ID NO: 2189 - DNA, 20 bp, Artificial Sequence
  Synthetic oligonucleotide
tttatcagcacagccagcca

SEQ ID NO: 2190 - DNA, 20 bp, Artificial Sequence
  Synthetic oligonucleotide
ctttatcagcacagccagcc

SEQ ID NO: 2191 - DNA, 20 bp, Artificial Sequence
  Synthetic oligonucleotide
gctttatcagcacagccagc

SEQ ID NO: 2192 - DNA, 20 bp, Artificial Sequence
  Synthetic oligonucleotide
tgctttatcagcacagccag

SEQ ID NO: 2193 - DNA, 20 bp, Artificial Sequence
  Synthetic oligonucleotide
atgctttatcagcacagcca

SEQ ID NO: 2194 - DNA, 20 bp, Artificial Sequence
  Synthetic oligonucleotide
aatgctttatcagcacagcc

SEQ ID NO: 2195 - DNA, 20 bp, Artificial Sequence
  Synthetic oligonucleotide
caatgctttatcagcacagc

SEQ ID NO: 2196 - DNA, 20 bp, Artificial Sequence
  Synthetic oligonucleotide
ccaatgctttatcagcacag

SEQ ID NO: 2197 - DNA, 20 bp, Artificial Sequence
  Synthetic oligonucleotide
cccaatgctttatcagcaca

SEQ ID NO: 2198 - DNA, 20 bp, Artificial Sequence
  Synthetic oligonucleotide
gcccaatgctttatcagcac

SEQ ID NO: 2199 - DNA, 20 bp, Artificial Sequence
  Synthetic oligonucleotide
agcccaatgctttatcagca

SEQ ID NO: 2200 - DNA, 20 bp, Artificial Sequence
  Synthetic oligonucleotide
aagcccaatgctttatcagc

SEQ ID NO: 2201 - DNA, 20 bp, Artificial Sequence
  Synthetic oligonucleotide
aggctccaacctctaaaaca

SEQ ID NO: 2202 - DNA, 20 bp, Artificial Sequence
  Synthetic oligonucleotide
aaggctccaacctctaaaac

SEQ ID NO: 2203 - DNA, 20 bp, Artificial Sequence
  Synthetic oligonucleotide
caaggctccaacctctaaaa

SEQ ID NO: 2204 - DNA, 20 bp, Artificial Sequence
  Synthetic oligonucleotide
tcaaggctccaacctctaaa

SEQ ID NO: 2205 - DNA, 20 bp, Artificial Sequence
  Synthetic oligonucleotide
atcaaggctccaacctctaa

SEQ ID NO: 2206 - DNA, 20 bp, Artificial Sequence
  Synthetic oligonucleotide
aatcaaggctccaacctcta

SEQ ID NO: 2207 - DNA, 20 bp, Artificial Sequence
  Synthetic oligonucleotide
aaatcaaggctccaacctct

SEQ ID NO: 2208 - DNA, 20 bp, Artificial Sequence
  Synthetic oligonucleotide
aaaatcaaggctccaacctc

SEQ ID NO: 2209 - DNA, 20 bp, Artificial Sequence
  Synthetic oligonucleotide
taaaatcaaggctccaacct

SEQ ID NO: 2210 - DNA, 20 bp, Artificial Sequence
  Synthetic oligonucleotide
ctaaaatcaaggctccaacc

SEQ ID NO: 2211 - DNA, 20 bp, Artificial Sequence
  Synthetic oligonucleotide
actaaaatcaaggctccaac

SEQ ID NO: 2212 - DNA, 20 bp, Artificial Sequence
  Synthetic oligonucleotide
gactaaaatcaaggctccaa

SEQ ID NO: 2213 - DNA, 20 bp, Artificial Sequence
  Synthetic oligonucleotide
agactaaaatcaaggctcca

SEQ ID NO: 2214 - DNA, 20 bp, Artificial Sequence
  Synthetic oligonucleotide
gagactaaaatcaaggctcc

SEQ ID NO: 2215 - DNA, 20 bp, Artificial Sequence
  Synthetic oligonucleotide
cagaactgaaattccttggt

SEQ ID NO: 2216 - DNA, 20 bp, Artificial Sequence
  Synthetic oligonucleotide
acagaactgaaattccttgg

SEQ ID NO: 2217 - DNA, 20 bp, Artificial Sequence
  Synthetic oligonucleotide
aacagaactgaaattccttg

SEQ ID NO: 2218 - DNA, 20 bp, Artificial Sequence
  Synthetic oligonucleotide
gaacagaactgaaattcctt

SEQ ID NO: 2219 - DNA, 20 bp, Artificial Sequence
  Synthetic oligonucleotide
agaacagaactgaaattcct

SEQ ID NO: 2220 - DNA, 20 bp, Artificial Sequence
  Synthetic oligonucleotide
aagaacagaactgaaattcc

SEQ ID NO: 2221 - DNA, 20 bp, Artificial Sequence
  Synthetic oligonucleotide
aaagaacagaactgaaattc

SEQ ID NO: 2222 - DNA, 20 bp, Artificial Sequence
  Synthetic oligonucleotide
aaaagaacagaactgaaatt

SEQ ID NO: 2223 - DNA, 20 bp, Artificial Sequence
  Synthetic oligonucleotide
caaaagaacagaactgaaat

SEQ ID NO: 2224 - DNA, 20 bp, Artificial Sequence
  Synthetic oligonucleotide
acaaaagaacagaactgaaa

SEQ ID NO: 2225 - DNA, 20 bp, Artificial Sequence
  Synthetic oligonucleotide
tacaaaagaacagaactgaa

SEQ ID NO: 2226 - DNA, 20 bp, Artificial Sequence
  Synthetic oligonucleotide
ctacaaaagaacagaactga

SEQ ID NO: 2227 - DNA, 20 bp, Artificial Sequence
  Synthetic oligonucleotide
cctacaaaagaacagaactg

SEQ ID NO: 2228 - DNA, 20 bp, Artificial Sequence
  Synthetic oligonucleotide
ccctacaaaagaacagaact

SEQ ID NO: 2229 - DNA, 20 bp, Artificial Sequence
  Synthetic oligonucleotide
cccctacaaaagaacagaac

SEQ ID NO: 2230 - DNA, 20 bp, Artificial Sequence
  Synthetic oligonucleotide
tcccctacaaaagaacagaa

SEQ ID NO: 2231 - DNA, 20 bp, Artificial Sequence
  Synthetic oligonucleotide
ttcccctacaaaagaacaga

SEQ ID NO: 2232 - DNA, 20 bp, Artificial Sequence
  Synthetic oligonucleotide
cttcccctacaaaagaacag

SEQ ID NO: 2233 - DNA, 20 bp, Artificial Sequence
  Synthetic oligonucleotide
gcttcccctacaaaagaaca

SEQ ID NO: 2234 - DNA, 20 bp, Artificial Sequence
  Synthetic oligonucleotide
agcttcccctacaaaagaac

SEQ ID NO: 2235 - DNA, 20 bp, Artificial Sequence
  Synthetic oligonucleotide
aagcttcccctacaaaagaa

SEQ ID NO: 2236 - DNA, 20 bp, Artificial Sequence
  Synthetic oligonucleotide
aaagcttcccctacaaaaga

SEQ ID NO: 2237 - DNA, 20 bp, Artificial Sequence
  Synthetic oligonucleotide
aaaagcttcccctacaaaag

SEQ ID NO: 2238 - DNA, 20 bp, Artificial Sequence
  Synthetic oligonucleotide
taaaagcttcccctacaaaa

SEQ ID NO: 2239 - DNA, 20 bp, Artificial Sequence
  Synthetic oligonucleotide
ttaaaagcttcccctacaaa

SEQ ID NO: 2240 - DNA, 20 bp, Artificial Sequence
  Synthetic oligonucleotide
tttaaaagcttcccctacaa

SEQ ID NO: 2241 - DNA, 20 bp, Artificial Sequence
  Synthetic oligonucleotide
ttttaaaagcttcccctaca

SEQ ID NO: 2242 - DNA, 20 bp, Artificial Sequence
  Synthetic oligonucleotide
cagtggtttttataaatgac

SEQ ID NO: 2243 - DNA, 20 bp, Artificial Sequence
  Synthetic oligonucleotide
tcagtggtttttataaatga

SEQ ID NO: 2244 - DNA, 20 bp, Artificial Sequence
  Synthetic oligonucleotide
ttcagtggtttttataaatg

SEQ ID NO: 2245 - DNA, 20 bp, Artificial Sequence
  Synthetic oligonucleotide
tttcagtggtttttataaat

SEQ ID NO: 2246 - DNA, 20 bp, Artificial Sequence
  Synthetic oligonucleotide
ctttcagtggtttttataaa

SEQ ID NO: 2247 - DNA, 20 bp, Artificial Sequence
  Synthetic oligonucleotide
tctttcagtggtttttataa

SEQ ID NO: 2248 - DNA, 20 bp, Artificial Sequence
  Synthetic oligonucleotide
ctctttcagtggtttttata

SEQ ID NO: 2249 - DNA, 20 bp, Artificial Sequence
  Synthetic oligonucleotide
actctttcagtggtttttat

SEQ ID NO: 2250 - DNA, 20 bp, Artificial Sequence
  Synthetic oligonucleotide
tactctttcagtggttttta

SEQ ID NO: 2251 - DNA, 20 bp, Artificial Sequence
  Synthetic oligonucleotide
gtactctttcagtggttttt

SEQ ID NO: 2252 - DNA, 20 bp, Artificial Sequence
  Synthetic oligonucleotide
agtactctttcagtggtttt

SEQ ID NO: 2253 - DNA, 20 bp, Artificial Sequence
  Synthetic oligonucleotide
caagtactctttcagtggtt

SEQ ID NO: 2254 - DNA, 20 bp, Artificial Sequence
  Synthetic oligonucleotide
tcaagtactctttcagtggt

SEQ ID NO: 2255 - DNA, 20 bp, Artificial Sequence
  Synthetic oligonucleotide
ctcaagtactctttcagtgg

SEQ ID NO: 2256 - DNA, 20 bp, Artificial Sequence
  Synthetic oligonucleotide
cctcaagtactctttcagtg

SEQ ID NO: 2257 - DNA, 20 bp, Artificial Sequence
  Synthetic oligonucleotide
ccctcaagtactctttcagt

SEQ ID NO: 2258 - DNA, 20 bp, Artificial Sequence
  Synthetic oligonucleotide
tccctcaagtactctttcag

SEQ ID NO: 2259 - DNA, 20 bp, Artificial Sequence
  Synthetic oligonucleotide
gtccctcaagtactctttca

SEQ ID NO: 2260 - DNA, 20 bp, Artificial Sequence
  Synthetic oligonucleotide
tgtccctcaagtactctttc

SEQ ID NO: 2261 - DNA, 20 bp, Artificial Sequence
  Synthetic oligonucleotide
atgtccctcaagtactcttt

SEQ ID NO: 2262 - DNA, 20 bp, Artificial Sequence
  Synthetic oligonucleotide
aaagggctgcaaaaaatctg

SEQ ID NO: 2263 - DNA, 20 bp, Artificial Sequence
  Synthetic oligonucleotide
gaaagggctgcaaaaaatct

SEQ ID NO: 2264 - DNA, 20 bp, Artificial Sequence
  Synthetic oligonucleotide
agaaagggctgcaaaaaatc

SEQ ID NO: 2265 - DNA, 20 bp, Artificial Sequence
  Synthetic oligonucleotide
cagaaagggctgcaaaaaat

SEQ ID NO: 2266 - DNA, 20 bp, Artificial Sequence
  Synthetic oligonucleotide
acagaaagggctgcaaaaaa

SEQ ID NO: 2267 - DNA, 20 bp, Artificial Sequence
  Synthetic oligonucleotide
aacagaaagggctgcaaaaa

SEQ ID NO: 2268 - DNA, 20 bp, Artificial Sequence
  Synthetic oligonucleotide
aaacagaaagggctgcaaaa

SEQ ID NO: 2269 - DNA, 20 bp, Artificial Sequence
  Synthetic oligonucleotide
taaacagaaagggctgcaaa

SEQ ID NO: 2270 - DNA, 20 bp, Artificial Sequence
  Synthetic oligonucleotide
ggtaaacagaaagggctgca

SEQ ID NO: 2271 - DNA, 20 bp, Artificial Sequence
  Synthetic oligonucleotide
tggtaaacagaaagggctgc

SEQ ID NO: 2272 - DNA, 20 bp, Artificial Sequence
  Synthetic oligonucleotide
ctggtaaacagaaagggctg

SEQ ID NO: 2273 - DNA, 20 bp, Artificial Sequence
  Synthetic oligonucleotide
cctggtaaacagaaagggct

SEQ ID NO: 2274 - DNA, 20 bp, Artificial Sequence
  Synthetic oligonucleotide
acctggtaaacagaaagggc

SEQ ID NO: 2275 - DNA, 20 bp, Artificial Sequence
  Synthetic oligonucleotide
aacctggtaaacagaaaggg

SEQ ID NO: 2276 - DNA, 20 bp, Artificial Sequence
  Synthetic oligonucleotide
taacctggtaaacagaaagg

SEQ ID NO: 2277 - DNA, 20 bp, Artificial Sequence
  Synthetic oligonucleotide
ataacctggtaaacagaaag

SEQ ID NO: 2278 - DNA, 20 bp, Artificial Sequence
  Synthetic oligonucleotide
gataacctggtaaacagaaa

SEQ ID NO: 2279 - DNA, 20 bp, Artificial Sequence
  Synthetic oligonucleotide
agataacctggtaaacagaa

SEQ ID NO: 2280 - DNA, 20 bp, Artificial Sequence
  Synthetic oligonucleotide
aagataacctggtaaacaga

SEQ ID NO: 2281 - DNA, 20 bp, Artificial Sequence
  Synthetic oligonucleotide
aatagcaatcaccttaggaa

SEQ ID NO: 2282 - DNA, 20 bp, Artificial Sequence
  Synthetic oligonucleotide
caatagcaatcaccttagga

SEQ ID NO: 2283 - DNA, 20 bp, Artificial Sequence
  Synthetic oligonucleotide
acaatagcaatcaccttagg

SEQ ID NO: 2284 - DNA, 20 bp, Artificial Sequence
  Synthetic oligonucleotide
ctacaatagcaatcacctta

SEQ ID NO: 2285 - DNA, 20 bp, Artificial Sequence
  Synthetic oligonucleotide
actacaatagcaatcacctt

SEQ ID NO: 2286 - DNA, 20 bp, Artificial Sequence
  Synthetic oligonucleotide
aactacaatagcaatcacct

SEQ ID NO: 2287 - DNA, 20 bp, Artificial Sequence
  Synthetic oligonucleotide
aaactacaatagcaatcacc

SEQ ID NO: 2288 - DNA, 20 bp, Artificial Sequence
  Synthetic oligonucleotide
aaaactacaatagcaatcac

SEQ ID NO: 2289 - DNA, 20 bp, Artificial Sequence
  Synthetic oligonucleotide
caaaactacaatagcaatca

SEQ ID NO: 2290 - DNA, 20 bp, Artificial Sequence
  Synthetic oligonucleotide
tcaaaactacaatagcaatc

SEQ ID NO: 2291 - DNA, 20 bp, Artificial Sequence
  Synthetic oligonucleotide
ttcaaaactacaatagcaat

SEQ ID NO: 2292 - DNA, 20 bp, Artificial Sequence
  Synthetic oligonucleotide
tttcaaaactacaatagcaa

SEQ ID NO: 2293 - DNA, 20 bp, Artificial Sequence
  Synthetic oligonucleotide
gtttcaaaactacaatagca

SEQ ID NO: 2294 - DNA, 20 bp, Artificial Sequence
  Synthetic oligonucleotide
tgtttcaaaactacaatagc

SEQ ID NO: 2295 - DNA, 20 bp, Artificial Sequence
  Synthetic oligonucleotide
gtgtttcaaaactacaatag

SEQ ID NO: 2296 - DNA, 20 bp, Artificial Sequence
  Synthetic oligonucleotide
agtgtttcaaaactacaata

SEQ ID NO: 2297 - DNA, 20 bp, Artificial Sequence
  Synthetic oligonucleotide
aagtgtttcaaaactacaat

SEQ ID NO: 2298 - DNA, 20 bp, Artificial Sequence
  Synthetic oligonucleotide
caagtgtttcaaaactacaa

SEQ ID NO: 2299 - DNA, 20 bp, Artificial Sequence
  Synthetic oligonucleotide
ccaagtgtttcaaaactaca

SEQ ID NO: 2300 - DNA, 20 bp, Artificial Sequence
  Synthetic oligonucleotide
accaagtgtttcaaaactac

SEQ ID NO: 2301 - DNA, 20 bp, Artificial Sequence
  Synthetic oligonucleotide
aaccaagtgtttcaaaacta

SEQ ID NO: 2302 - DNA, 20 bp, Artificial Sequence
  Synthetic oligonucleotide
caaccaagtgtttcaaaact

SEQ ID NO: 2303 - DNA, 20 bp, Artificial Sequence
  Synthetic oligonucleotide
cacctgcccctatgtataag

SEQ ID NO: 2304 - DNA, 20 bp, Artificial Sequence
  Synthetic oligonucleotide
ccacctgcccctatgtataa

SEQ ID NO: 2305 - DNA, 20 bp, Artificial Sequence
  Synthetic oligonucleotide
tccacctgcccctatgtata

SEQ ID NO: 2306 - DNA, 20 bp, Artificial Sequence
  Synthetic oligonucleotide
ttccacctgcccctatgtat

SEQ ID NO: 2307 - DNA, 20 bp, Artificial Sequence
  Synthetic oligonucleotide
attccacctgcccctatgta

SEQ ID NO: 2308 - DNA, 20 bp, Artificial Sequence
  Synthetic oligonucleotide
tattccacctgcccctatgt

SEQ ID NO: 2309 - DNA, 20 bp, Artificial Sequence
  Synthetic oligonucleotide
ttattccacctgcccctatg

SEQ ID NO: 2310 - DNA, 20 bp, Artificial Sequence
  Synthetic oligonucleotide
tttattccacctgcccctat

SEQ ID NO: 2311 - DNA, 20 bp, Artificial Sequence
  Synthetic oligonucleotide
ttttattccacctgccccta

SEQ ID NO: 2312 - DNA, 20 bp, Artificial Sequence
  Synthetic oligonucleotide
gttttattccacctgcccct

SEQ ID NO: 2313 - DNA, 20 bp, Artificial Sequence
  Synthetic oligonucleotide
tgttttattccacctgcccc

SEQ ID NO: 2314 - DNA, 20 bp, Artificial Sequence
  Synthetic oligonucleotide
atgttttattccacctgccc

SEQ ID NO: 2315 - DNA, 20 bp, Artificial Sequence
  Synthetic oligonucleotide
tatgttttattccacctgcc

SEQ ID NO: 2316 - DNA, 20 bp, Artificial Sequence
  Synthetic oligonucleotide
ttatgttttattccacctgc

SEQ ID NO: 2317 - DNA, 20 bp, Artificial Sequence
  Synthetic oligonucleotide
attatgttttattccacctg

SEQ ID NO: 2318 - DNA, 20 bp, Artificial Sequence
  Synthetic oligonucleotide
aattatgttttattccacct

SEQ ID NO: 2319 - DNA, 20 bp, Artificial Sequence
  Synthetic oligonucleotide
taattatgttttattccacc

SEQ ID NO: 2320 - DNA, 20 bp, Artificial Sequence
  Synthetic oligonucleotide
ctaattatgttttattccac

SEQ ID NO: 2321 - DNA, 20 bp, Artificial Sequence
  Synthetic oligonucleotide
cctaattatgttttattcca

SEQ ID NO: 2322 - DNA, 20 bp, Artificial Sequence
  Synthetic oligonucleotide
tcctaattatgttttattcc

SEQ ID NO: 2323 - DNA, 20 bp, Artificial Sequence
  Synthetic oligonucleotide
ctcctaattatgttttattc

SEQ ID NO: 2324 - DNA, 20 bp, Artificial Sequence
  Synthetic oligonucleotide
cctcctaattatgttttatt

SEQ ID NO: 2325 - DNA, 20 bp, Artificial Sequence
  Synthetic oligonucleotide
tggcttcttcctgagacaca

SEQ ID NO: 2326 - DNA, 20 bp, Artificial Sequence
  Synthetic oligonucleotide
ttggcttcttcctgagacac

SEQ ID NO: 2327 - DNA, 20 bp, Artificial Sequence
  Synthetic oligonucleotide
gttggcttcttcctgagaca

SEQ ID NO: 2328 - DNA, 20 bp, Artificial Sequence
  Synthetic oligonucleotide
tgttggcttcttcctgagac

SEQ ID NO: 2329 - DNA, 20 bp, Artificial Sequence
  Synthetic oligonucleotide
ctgttggcttcttcctgaga

SEQ ID NO: 2330 - DNA, 20 bp, Artificial Sequence
  Synthetic oligonucleotide
cctgttggcttcttcctgag

SEQ ID NO: 2331 - DNA, 20 bp, Artificial Sequence
  Synthetic oligonucleotide
tcctgttggcttcttcctga

SEQ ID NO: 2332 - DNA, 20 bp, Artificial Sequence
  Synthetic oligonucleotide
ctcctgttggcttcttcctg

SEQ ID NO: 2333 - DNA, 20 bp, Artificial Sequence
  Synthetic oligonucleotide
cctcctgttggcttcttcct

SEQ ID NO: 2334 - DNA, 20 bp, Artificial Sequence
  Synthetic oligonucleotide
tcctcctgttggcttcttcc

SEQ ID NO: 2335 - DNA, 20 bp, Artificial Sequence
  Synthetic oligonucleotide
ttcctcctgttggcttcttc

SEQ ID NO: 2336 - DNA, 20 bp, Artificial Sequence
  Synthetic oligonucleotide
gttcctcctgttggcttctt

SEQ ID NO: 2337 - DNA, 20 bp, Artificial Sequence
  Synthetic oligonucleotide
ggttcctcctgttggcttct

SEQ ID NO: 2338 - DNA, 20 bp, Artificial Sequence
  Synthetic oligonucleotide
aggttcctcctgttggcttc

SEQ ID NO: 2339 - DNA, 20 bp, Artificial Sequence
  Synthetic oligonucleotide
aaggttcctcctgttggctt

SEQ ID NO: 2340 - DNA, 20 bp, Artificial Sequence
  Synthetic oligonucleotide
taaggttcctcctgttggct

SEQ ID NO: 2341 - DNA, 20 bp, Artificial Sequence
  Synthetic oligonucleotide
ataaggttcctcctgttggc

SEQ ID NO: 2342 - DNA, 20 bp, Artificial Sequence
  Synthetic oligonucleotide
aataaggttcctcctgttgg

SEQ ID NO: 2343 - DNA, 20 bp, Artificial Sequence
  Synthetic oligonucleotide
aaataaggttcctcctgttg

SEQ ID NO: 2344 - DNA, 20 bp, Artificial Sequence
  Synthetic oligonucleotide
aaaataaggttcctcctgtt

SEQ ID NO: 2345 - DNA, 20 bp, Artificial Sequence
  Synthetic oligonucleotide
caaaataaggttcctcctgt

SEQ ID NO: 2346 - DNA, 20 bp, Artificial Sequence
  Synthetic oligonucleotide
tcaaaataaggttcctcctg

SEQ ID NO: 2347 - DNA, 20 bp, Artificial Sequence
  Synthetic oligonucleotide
ctcaaaataaggttcctcct

SEQ ID NO: 2348 - DNA, 20 bp, Artificial Sequence
  Synthetic oligonucleotide
actcaaaataaggttcctcc

SEQ ID NO: 2349 - DNA, 20 bp, Artificial Sequence
  Synthetic oligonucleotide
tgactcaaaataaggttcct

SEQ ID NO: 2350 - DNA, 20 bp, Artificial Sequence
  Synthetic oligonucleotide
ctgactcaaaataaggttcc

SEQ ID NO: 2351 - DNA, 20 bp, Artificial Sequence
  Synthetic oligonucleotide
cctgactcaaaataaggttc

SEQ ID NO: 2352 - DNA, 20 bp, Artificial Sequence
  Synthetic oligonucleotide
acctgactcaaaataaggtt

SEQ ID NO: 2353 - DNA, 20 bp, Artificial Sequence
  Synthetic oligonucleotide
ttaatctttcctaggcaaag

SEQ ID NO: 2354 - DNA, 20 bp, Artificial Sequence
  Synthetic oligonucleotide
attaatctttcctaggcaaa

SEQ ID NO: 2355 - DNA, 20 bp, Artificial Sequence
  Synthetic oligonucleotide
cattaatctttcctaggcaa

SEQ ID NO: 2356 - DNA, 20 bp, Artificial Sequence
  Synthetic oligonucleotide
gcattaatctttcctaggca

SEQ ID NO: 2357 - DNA, 20 bp, Artificial Sequence
  Synthetic oligonucleotide
agcattaatctttcctaggc

SEQ ID NO: 2358 - DNA, 20 bp, Artificial Sequence
  Synthetic oligonucleotide
ttagcattaatctttcctag

SEQ ID NO: 2359 - DNA, 20 bp, Artificial Sequence
  Synthetic oligonucleotide
attagcattaatctttccta

SEQ ID NO: 2360 - DNA, 20 bp, Artificial Sequence
  Synthetic oligonucleotide
gattagcattaatctttcct

SEQ ID NO: 2361 - DNA, 20 bp, Artificial Sequence
  Synthetic oligonucleotide
agattagcattaatctttcc

SEQ ID NO: 2362 - DNA, 20 bp, Artificial Sequence
  Synthetic oligonucleotide
aagattagcattaatctttc

SEQ ID NO: 2363 - DNA, 20 bp, Artificial Sequence
  Synthetic oligonucleotide
taagattagcattaatcttt

SEQ ID NO: 2364 - DNA, 20 bp, Artificial Sequence
  Synthetic oligonucleotide
cttcttcctgagacacagcc

SEQ ID NO: 2365 - DNA, 20 bp, Artificial Sequence
  Synthetic oligonucleotide
gcttcttcctgagacacagc

SEQ ID NO: 2366 - DNA, 20 bp, Artificial Sequence
  Synthetic oligonucleotide
ggcttcttcctgagacacag

SEQ ID NO: 2367 - DNA, 20 bp, Artificial Sequence
  Synthetic oligonucleotide
tgaggatgaccccagataaa

SEQ ID NO: 2368 - DNA, 20 bp, Artificial Sequence
  Synthetic oligonucleotide
gtgaggatgaccccagataa

SEQ ID NO: 2369 - DNA, 20 bp, Artificial Sequence
  Synthetic oligonucleotide
tgtgaggatgaccccagata

SEQ ID NO: 2370 - DNA, 20 bp, Artificial Sequence
  Synthetic oligonucleotide
ctgtgaggatgaccccagat

SEQ ID NO: 2371 - DNA, 20 bp, Artificial Sequence
  Synthetic oligonucleotide
cctgtgaggatgaccccaga

SEQ ID NO: 2372 - DNA, 20 bp, Artificial Sequence
  Synthetic oligonucleotide
gcctgtgaggatgaccccag

SEQ ID NO: 2373 - DNA, 20 bp, Artificial Sequence
  Synthetic oligonucleotide
tgcctgtgaggatgacccca

SEQ ID NO: 2374 - DNA, 20 bp, Artificial Sequence
  Synthetic oligonucleotide
atgcctgtgaggatgacccc

SEQ ID NO: 2375 - DNA, 20 bp, Artificial Sequence
  Synthetic oligonucleotide
tatgcctgtgaggatgaccc

SEQ ID NO: 2376 - DNA, 20 bp, Artificial Sequence
  Synthetic oligonucleotide
ctatgcctgtgaggatgacc

SEQ ID NO: 2377 - DNA, 20 bp, Artificial Sequence
  Synthetic oligonucleotide
gctatgcctgtgaggatgac

SEQ ID NO: 2378 - DNA, 20 bp, Artificial Sequence
  Synthetic oligonucleotide
tgctatgcctgtgaggatga

SEQ ID NO: 2379 - DNA, 20 bp, Artificial Sequence
  Synthetic oligonucleotide
ctgctatgcctgtgaggatg

SEQ ID NO: 2380 - DNA, 20 bp, Artificial Sequence
  Synthetic oligonucleotide
tctgctatgcctgtgaggat

SEQ ID NO: 2381 - DNA, 20 bp, Artificial Sequence
  Synthetic oligonucleotide
atctgctatgcctgtgagga

SEQ ID NO: 2382 - DNA, 20 bp, Artificial Sequence
  Synthetic oligonucleotide
tatctgctatgcctgtgagg

SEQ ID NO: 2383 - DNA, 20 bp, Artificial Sequence
  Synthetic oligonucleotide
atatctgctatgcctgtgag

SEQ ID NO: 2384 - DNA, 20 bp, Artificial Sequence
  Synthetic oligonucleotide
aatatctgctatgcctgtga

SEQ ID NO: 2385 - DNA, 20 bp, Artificial Sequence
  Synthetic oligonucleotide
gaatatctgctatgcctgtg

SEQ ID NO: 2386 - DNA, 20 bp, Artificial Sequence
  Synthetic oligonucleotide
agaatatctgctatgcctgt

SEQ ID NO: 2387 - DNA, 20 bp, Artificial Sequence
  Synthetic oligonucleotide
cagaatatctgctatgcctg

SEQ ID NO: 2388 - DNA, 20 bp, Artificial Sequence
  Synthetic oligonucleotide
tcagaatatctgctatgcct

SEQ ID NO: 2389 - DNA, 20 bp, Artificial Sequence
  Synthetic oligonucleotide
atcagaatatctgctatgcc

SEQ ID NO: 2390 - DNA, 20 bp, Artificial Sequence
  Synthetic oligonucleotide
aatcagaatatctgctatgc

SEQ ID NO: 2391 - DNA, 20 bp, Artificial Sequence
  Synthetic oligonucleotide
gaatcagaatatctgctatg

SEQ ID NO: 2392 - DNA, 20 bp, Artificial Sequence
  Synthetic oligonucleotide
tgaatcagaatatctgctat

SEQ ID NO: 2393 - DNA, 20 bp, Artificial Sequence
  Synthetic oligonucleotide
ctgaatcagaatatctgcta

SEQ ID NO: 2394 - DNA, 20 bp, Artificial Sequence
  Synthetic oligonucleotide
tctgaatcagaatatctgct

SEQ ID NO: 2395 - DNA, 20 bp, Artificial Sequence
  Synthetic oligonucleotide
catctgaatcagaatatctg

SEQ ID NO: 2396 - DNA, 20 bp, Artificial Sequence
  Synthetic oligonucleotide
ccatctgaatcagaatatct

SEQ ID NO: 2397 - DNA, 20 bp, Artificial Sequence
  Synthetic oligonucleotide
accatctgaatcagaatatc

SEQ ID NO: 2398 - DNA, 20 bp, Artificial Sequence
  Synthetic oligonucleotide
gaccatctgaatcagaatat

SEQ ID NO: 2399 - DNA, 20 bp, Artificial Sequence
  Synthetic oligonucleotide
ggaccatctgaatcagaata

SEQ ID NO: 2400 - DNA, 20 bp, Artificial Sequence
  Synthetic oligonucleotide
aggaccatctgaatcagaat

SEQ ID NO: 2401 - DNA, 20 bp, Artificial Sequence
  Synthetic oligonucleotide
aaggaccatctgaatcagaa

SEQ ID NO: 2402 - DNA, 20 bp, Artificial Sequence
  Synthetic oligonucleotide
caaggaccatctgaatcaga

SEQ ID NO: 2403 - DNA, 20 bp, Artificial Sequence
  Synthetic oligonucleotide
ccaaggaccatctgaatcag

SEQ ID NO: 2404 - DNA, 20 bp, Artificial Sequence
  Synthetic oligonucleotide
accaaggaccatctgaatca

SEQ ID NO: 2405 - DNA, 20 bp, Artificial Sequence
  Synthetic oligonucleotide
gaccaaggaccatctgaatc

SEQ ID NO: 2406 - DNA, 20 bp, Artificial Sequence
  Synthetic oligonucleotide
ggaccaaggaccatctgaat

SEQ ID NO: 2407 - DNA, 20 bp, Artificial Sequence
  Synthetic oligonucleotide
aggaccaaggaccatctgaa

SEQ ID NO: 2408 - DNA, 20 bp, Artificial Sequence
  Synthetic oligonucleotide
aaggaccaaggaccatctga

SEQ ID NO: 2409 - DNA, 20 bp, Artificial Sequence
  Synthetic oligonucleotide
taaggaccaaggaccatctg

SEQ ID NO: 2410 - DNA, 20 bp, Artificial Sequence
  Synthetic oligonucleotide
ctaaggaccaaggaccatct

SEQ ID NO: 2411 - DNA, 20 bp, Artificial Sequence
  Synthetic oligonucleotide
actaaggaccaaggaccatc

SEQ ID NO: 2412 - DNA, 20 bp, Artificial Sequence
  Synthetic oligonucleotide
aactaaggaccaaggaccat

SEQ ID NO: 2413 - DNA, 20 bp, Artificial Sequence
  Synthetic oligonucleotide
aaactaaggaccaaggacca

SEQ ID NO: 2414 - DNA, 20 bp, Artificial Sequence
  Synthetic oligonucleotide
caaactaaggaccaaggacc

SEQ ID NO: 2415 - DNA, 20 bp, Artificial Sequence
  Synthetic oligonucleotide
tcaaactaaggaccaaggac

SEQ ID NO: 2416 - DNA, 20 bp, Artificial Sequence
  Synthetic oligonucleotide
ctcaaactaaggaccaagga

SEQ ID NO: 2417 - DNA, 20 bp, Artificial Sequence
  Synthetic oligonucleotide
caacagagtgaaatgtaatg

SEQ ID NO: 2418 - DNA, 20 bp, Artificial Sequence
  Synthetic oligonucleotide
tcaacagagtgaaatgtaat

SEQ ID NO: 2419 - DNA, 20 bp, Artificial Sequence
  Synthetic oligonucleotide
ctcaacagagtgaaatgtaa

SEQ ID NO: 2420 - DNA, 20 bp, Artificial Sequence
  Synthetic oligonucleotide
gctcaacagagtgaaatgta

SEQ ID NO: 2421 - DNA, 20 bp, Artificial Sequence
  Synthetic oligonucleotide
tgctcaacagagtgaaatgt

SEQ ID NO: 2422 - DNA, 20 bp, Artificial Sequence
  Synthetic oligonucleotide
atgctcaacagagtgaaatg

SEQ ID NO: 2423 - DNA, 20 bp, Artificial Sequence
  Synthetic oligonucleotide
aatgctcaacagagtgaaat

SEQ ID NO: 2424 - DNA, 20 bp, Artificial Sequence
  Synthetic oligonucleotide
gaatgctcaacagagtgaaa

SEQ ID NO: 2425 - DNA, 20 bp, Artificial Sequence
  Synthetic oligonucleotide
agaatgctcaacagagtgaa

SEQ ID NO: 2426 - DNA, 20 bp, Artificial Sequence
  Synthetic oligonucleotide
tagaatgctcaacagagtga

SEQ ID NO: 2427 - DNA, 20 bp, Artificial Sequence
  Synthetic oligonucleotide
atagaatgctcaacagagtg

SEQ ID NO: 2428 - DNA, 20 bp, Artificial Sequence
  Synthetic oligonucleotide
catagaatgctcaacagagt

SEQ ID NO: 2429 - DNA, 20 bp, Artificial Sequence
  Synthetic oligonucleotide
ccatagaatgctcaacagag

SEQ ID NO: 2430 - DNA, 20 bp, Artificial Sequence
  Synthetic oligonucleotide
tccatagaatgctcaacaga

SEQ ID NO: 2431 - DNA, 20 bp, Artificial Sequence
  Synthetic oligonucleotide
atccatagaatgctcaacag

SEQ ID NO: 2432 - DNA, 20 bp, Artificial Sequence
  Synthetic oligonucleotide
aatccatagaatgctcaaca

SEQ ID NO: 2433 - DNA, 20 bp, Artificial Sequence
  Synthetic oligonucleotide
aaatccatagaatgctcaac

SEQ ID NO: 2434 - DNA, 20 bp, Artificial Sequence
  Synthetic oligonucleotide
aaaatccatagaatgctcaa

SEQ ID NO: 2435 - DNA, 20 bp, Artificial Sequence
  Synthetic oligonucleotide
caaaatccatagaatgctca

SEQ ID NO: 2436 - DNA, 20 bp, Artificial Sequence
  Synthetic oligonucleotide
tcaaaatccatagaatgctc

SEQ ID NO: 2437 - DNA, 20 bp, Artificial Sequence
  Synthetic oligonucleotide
gtcaaaatccatagaatgct

SEQ ID NO: 2438 - DNA, 20 bp, Artificial Sequence
  Synthetic oligonucleotide
tgtcaaaatccatagaatgc

SEQ ID NO: 2439 - DNA, 20 bp, Artificial Sequence
  Synthetic oligonucleotide
ttgtcaaaatccatagaatg

SEQ ID NO: 2440 - DNA, 20 bp, Artificial Sequence
  Synthetic oligonucleotide
tttgtcaaaatccatagaat

SEQ ID NO: 2441 - DNA, 20 bp, Artificial Sequence
  Synthetic oligonucleotide
atttgtcaaaatccatagaa

SEQ ID NO: 2442 - DNA, 20 bp, Artificial Sequence
  Synthetic oligonucleotide
catttgtcaaaatccataga

SEQ ID NO: 2443 - DNA, 20 bp, Artificial Sequence
  Synthetic oligonucleotide
acatttgtcaaaatccatag

SEQ ID NO: 2444 - DNA, 20 bp, Artificial Sequence
  Synthetic oligonucleotide
cacatttgtcaaaatccata

SEQ ID NO: 2445 - DNA, 20 bp, Artificial Sequence
  Synthetic oligonucleotide
acacatttgtcaaaatccat

SEQ ID NO: 2446 - DNA, 20 bp, Artificial Sequence
  Synthetic oligonucleotide
cacacatttgtcaaaatcca

SEQ ID NO: 2447 - DNA, 20 bp, Artificial Sequence
  Synthetic oligonucleotide
atcacacatttgtcaaaatc

SEQ ID NO: 2448 - DNA, 20 bp, Artificial Sequence
  Synthetic oligonucleotide
catcacacatttgtcaaaat

SEQ ID NO: 2449 - DNA, 20 bp, Artificial Sequence
  Synthetic oligonucleotide
tcatcacacatttgtcaaaa

SEQ ID NO: 2450 - DNA, 20 bp, Artificial Sequence
  Synthetic oligonucleotide
atcatcacacatttgtcaaa

SEQ ID NO: 2451 - DNA, 20 bp, Artificial Sequence
  Synthetic oligonucleotide
catcatcacacatttgtcaa

SEQ ID NO: 2452 - DNA, 20 bp, Artificial Sequence
  Synthetic oligonucleotide
acatcatcacacatttgtca

SEQ ID NO: 2453 - DNA, 20 bp, Artificial Sequence
  Synthetic oligonucleotide
tacatcatcacacatttgtc

SEQ ID NO: 2454 - DNA, 20 bp, Artificial Sequence
  Synthetic oligonucleotide
atacatcatcacacatttgt

SEQ ID NO: 2455 - DNA, 20 bp, Artificial Sequence
  Synthetic oligonucleotide
tatacatcatcacacatttg

SEQ ID NO: 2456 - DNA, 20 bp, Artificial Sequence
  Synthetic oligonucleotide
atatacatcatcacacattt

SEQ ID NO: 2457 - DNA, 20 bp, Artificial Sequence
  Synthetic oligonucleotide
ttatataattgtgtactggc

SEQ ID NO: 2458 - DNA, 20 bp, Artificial Sequence
  Synthetic oligonucleotide
tttatataattgtgtactgg

SEQ ID NO: 2459 - DNA, 20 bp, Artificial Sequence
  Synthetic oligonucleotide
ttttatataattgtgtactg

SEQ ID NO: 2460 - DNA, 20 bp, Artificial Sequence
  Synthetic oligonucleotide
attttatataattgtgtact

SEQ ID NO: 2461 - DNA, 20 bp, Artificial Sequence
  Synthetic oligonucleotide
tattttatataattgtgtac

SEQ ID NO: 2462 - DNA, 20 bp, Artificial Sequence
  Synthetic oligonucleotide
ctattttatataattgtgta

SEQ ID NO: 2463 - DNA, 20 bp, Artificial Sequence
  Synthetic oligonucleotide
actattttatataattgtgt

SEQ ID NO: 2464 - DNA, 20 bp, Artificial Sequence
  Synthetic oligonucleotide
aactattttatataattgtg

SEQ ID NO: 2465 - DNA, 20 bp, Artificial Sequence
  Synthetic oligonucleotide
aaactattttatataattgt

SEQ ID NO: 2466 - DNA, 20 bp, Artificial Sequence
  Synthetic oligonucleotide
taatgagactttagcactct

SEQ ID NO: 2467 - DNA, 20 bp, Artificial Sequence
  Synthetic oligonucleotide
aataatgagactttagcact

SEQ ID NO: 2468 - DNA, 20 bp, Artificial Sequence
  Synthetic oligonucleotide
caataatgagactttagcac

SEQ ID NO: 2469 - DNA, 20 bp, Artificial Sequence
  Synthetic oligonucleotide
gcaataatgagactttagca

SEQ ID NO: 2470 - DNA, 20 bp, Artificial Sequence
  Synthetic oligonucleotide
ctgcaataatgagactttag

SEQ ID NO: 2471 - DNA, 20 bp, Artificial Sequence
  Synthetic oligonucleotide
actgcaataatgagacttta

SEQ ID NO: 2472 - DNA, 20 bp, Artificial Sequence
  Synthetic oligonucleotide
aactgcaataatgagacttt

SEQ ID NO: 2473 - DNA, 20 bp, Artificial Sequence
  Synthetic oligonucleotide
atttgaataaatgaatgaaa

SEQ ID NO: 2474 - DNA, 20 bp, Artificial Sequence
  Synthetic oligonucleotide
tatttgaataaatgaatgaa

SEQ ID NO: 2475 - DNA, 20 bp, Artificial Sequence
  Synthetic oligonucleotide
atatttgaataaatgaatga

SEQ ID NO: 2476 - DNA, 20 bp, Artificial Sequence
  Synthetic oligonucleotide
aatatttgaataaatgaatg

SEQ ID NO: 2477 - DNA, 20 bp, Artificial Sequence
  Synthetic oligonucleotide
aaatatttgaataaatgaat

SEQ ID NO: 2478 - DNA, 20 bp, Artificial Sequence
  Synthetic oligonucleotide
caaatatttgaataaatgaa

SEQ ID NO: 2479 - DNA, 20 bp, Artificial Sequence
  Synthetic oligonucleotide
tcaaatatttgaataaatga

SEQ ID NO: 2480 - DNA, 20 bp, Artificial Sequence
  Synthetic oligonucleotide
ctcaaatatttgaataaatg

SEQ ID NO: 2481 - DNA, 20 bp, Artificial Sequence
  Synthetic oligonucleotide
gctcaaatatttgaataaat

SEQ ID NO: 2482 - DNA, 20 bp, Artificial Sequence
  Synthetic oligonucleotide
tgctcaaatatttgaataaa

SEQ ID NO: 2483 - DNA, 20 bp, Artificial Sequence
  Synthetic oligonucleotide
atgctcaaatatttgaataa

SEQ ID NO: 2484 - DNA, 20 bp, Artificial Sequence
  Synthetic oligonucleotide
aatgctcaaatatttgaata

SEQ ID NO: 2485 - DNA, 20 bp, Artificial Sequence
  Synthetic oligonucleotide
gaatgctcaaatatttgaat

SEQ ID NO: 2486 - DNA, 20 bp, Artificial Sequence
  Synthetic oligonucleotide
agaatgctcaaatatttgaa

SEQ ID NO: 2487 - DNA, 20 bp, Artificial Sequence
  Synthetic oligonucleotide
cagaatgctcaaatatttga

SEQ ID NO: 2488 - DNA, 20 bp, Artificial Sequence
  Synthetic oligonucleotide
acagaatgctcaaatatttg

SEQ ID NO: 2489 - DNA, 20 bp, Artificial Sequence
  Synthetic oligonucleotide
tacagaatgctcaaatattt

SEQ ID NO: 2490 - DNA, 20 bp, Artificial Sequence
  Synthetic oligonucleotide
ctacagaatgctcaaatatt

SEQ ID NO: 2491 - DNA, 20 bp, Artificial Sequence
  Synthetic oligonucleotide
actacagaatgctcaaatat

SEQ ID NO: 2492 - DNA, 20 bp, Artificial Sequence
  Synthetic oligonucleotide
aactacagaatgctcaaata

SEQ ID NO: 2493 - DNA, 20 bp, Artificial Sequence
  Synthetic oligonucleotide
caactacagaatgctcaaat

SEQ ID NO: 2494 - DNA, 20 bp, Artificial Sequence
  Synthetic oligonucleotide
gcaactacagaatgctcaaa

SEQ ID NO: 2495 - DNA, 20 bp, Artificial Sequence
  Synthetic oligonucleotide
agcaactacagaatgctcaa

SEQ ID NO: 2496 - DNA, 20 bp, Artificial Sequence
  Synthetic oligonucleotide
cagcaactacagaatgctca

SEQ ID NO: 2497 - DNA, 20 bp, Artificial Sequence
  Synthetic oligonucleotide
ccagcaactacagaatgctc

SEQ ID NO: 2498 - DNA, 20 bp, Artificial Sequence
  Synthetic oligonucleotide
cccagcaactacagaatgct

SEQ ID NO: 2499 - DNA, 20 bp, Artificial Sequence
  Synthetic oligonucleotide
ccccagcaactacagaatgc

SEQ ID NO: 2500 - DNA, 20 bp, Artificial Sequence
  Synthetic oligonucleotide
tccccagcaactacagaatg

SEQ ID NO: 2501 - DNA, 20 bp, Artificial Sequence
  Synthetic oligonucleotide
ttccccagcaactacagaat

SEQ ID NO: 2502 - DNA, 20 bp, Artificial Sequence
  Synthetic oligonucleotide
tttccccagcaactacagaa

SEQ ID NO: 2503 - DNA, 20 bp, Artificial Sequence
  Synthetic oligonucleotide
atttccccagcaactacaga

SEQ ID NO: 2504 - DNA, 20 bp, Artificial Sequence
  Synthetic oligonucleotide
tatttccccagcaactacag

SEQ ID NO: 2505 - DNA, 20 bp, Artificial Sequence
  Synthetic oligonucleotide
ctatttccccagcaactaca

SEQ ID NO: 2506 - DNA, 20 bp, Artificial Sequence
  Synthetic oligonucleotide
gctatttccccagcaactac

SEQ ID NO: 2507 - DNA, 20 bp, Artificial Sequence
  Synthetic oligonucleotide
tgctatttccccagcaacta

SEQ ID NO: 2508 - DNA, 20 bp, Artificial Sequence
  Synthetic oligonucleotide
ctgctatttccccagcaact

SEQ ID NO: 2509 - DNA, 20 bp, Artificial Sequence
  Synthetic oligonucleotide
actgctatttccccagcaac

SEQ ID NO: 2510 - DNA, 20 bp, Artificial Sequence
  Synthetic oligonucleotide
tcactgctatttccccagca

SEQ ID NO: 2511 - DNA, 20 bp, Artificial Sequence
  Synthetic oligonucleotide
ttcactgctatttccccagc

SEQ ID NO: 2512 - DNA, 20 bp, Artificial Sequence
  Synthetic oligonucleotide
gttcactgctatttccccag

SEQ ID NO: 2513 - DNA, 20 bp, Artificial Sequence
  Synthetic oligonucleotide
agttcactgctatttcccca

SEQ ID NO: 2514 - DNA, 20 bp, Artificial Sequence
  Synthetic oligonucleotide
cagttcactgctatttcccc

SEQ ID NO: 2515 - DNA, 20 bp, Artificial Sequence
  Synthetic oligonucleotide
tcagttcactgctatttccc

SEQ ID NO: 2516 - DNA, 20 bp, Artificial Sequence
  Synthetic oligonucleotide
ttcagttcactgctatttcc

SEQ ID NO: 2517 - DNA, 20 bp, Artificial Sequence
  Synthetic oligonucleotide
cttcagttcactgctatttc

SEQ ID NO: 2518 - DNA, 20 bp, Artificial Sequence
  Synthetic oligonucleotide
tcttcagttcactgctattt

SEQ ID NO: 2519 - DNA, 20 bp, Artificial Sequence
  Synthetic oligonucleotide
ttcttcagttcactgctatt

SEQ ID NO: 2520 - DNA, 20 bp, Artificial Sequence
  Synthetic oligonucleotide
attcttcagttcactgctat

SEQ ID NO: 2521 - DNA, 20 bp, Artificial Sequence
  Synthetic oligonucleotide
cattcttcagttcactgcta

SEQ ID NO: 2522 - DNA, 20 bp, Artificial Sequence
  Synthetic oligonucleotide
acattcttcagttcactgct

SEQ ID NO: 2523 - DNA, 20 bp, Artificial Sequence
  Synthetic oligonucleotide
gacattcttcagttcactgc

SEQ ID NO: 2524 - DNA, 20 bp, Artificial Sequence
  Synthetic oligonucleotide
agacattcttcagttcactg

SEQ ID NO: 2525 - DNA, 20 bp, Artificial Sequence
  Synthetic oligonucleotide
aagacattcttcagttcact

SEQ ID NO: 2526 - DNA, 20 bp, Artificial Sequence
  Synthetic oligonucleotide
aaagacattcttcagttcac

SEQ ID NO: 2527 - DNA, 20 bp, Artificial Sequence
  Synthetic oligonucleotide
caaagacattcttcagttca

SEQ ID NO: 2528 - DNA, 20 bp, Artificial Sequence
  Synthetic oligonucleotide
acaaagacattcttcagttc

SEQ ID NO: 2529 - DNA, 20 bp, Artificial Sequence
  Synthetic oligonucleotide
aacaaagacattcttcagtt

SEQ ID NO: 2530 - DNA, 20 bp, Artificial Sequence
  Synthetic oligonucleotide
gaacaaagacattcttcagt

SEQ ID NO: 2531 - DNA, 20 bp, Artificial Sequence
  Synthetic oligonucleotide
agaacaaagacattcttcag

SEQ ID NO: 2532 - DNA, 20 bp, Artificial Sequence
  Synthetic oligonucleotide
aagaacaaagacattcttca

SEQ ID NO: 2533 - DNA, 20 bp, Artificial Sequence
  Synthetic oligonucleotide
taagaacaaagacattcttc

SEQ ID NO: 2534 - DNA, 20 bp, Artificial Sequence
  Synthetic oligonucleotide
ataagaacaaagacattctt

SEQ ID NO: 2535 - DNA, 20 bp, Artificial Sequence
  Synthetic oligonucleotide
cataagaacaaagacattct

SEQ ID NO: 2536 - DNA, 20 bp, Artificial Sequence
  Synthetic oligonucleotide
ccataagaacaaagacattc

SEQ ID NO: 2537 - DNA, 20 bp, Artificial Sequence
  Synthetic oligonucleotide
cccataagaacaaagacatt

SEQ ID NO: 2538 - DNA, 20 bp, Artificial Sequence
  Synthetic oligonucleotide
ccccataagaacaaagacat

SEQ ID NO: 2539 - DNA, 20 bp, Artificial Sequence
  Synthetic oligonucleotide
gccccataagaacaaagaca

SEQ ID NO: 2540 - DNA, 20 bp, Artificial Sequence
  Synthetic oligonucleotide
agccccataagaacaaagac

SEQ ID NO: 2541 - DNA, 20 bp, Artificial Sequence
  Synthetic oligonucleotide
aagccccataagaacaaaga

SEQ ID NO: 2542 - DNA, 20 bp, Artificial Sequence
  Synthetic oligonucleotide
tctccagcctacagatgact

SEQ ID NO: 2543 - DNA, 20 bp, Artificial Sequence
  Synthetic oligonucleotide
ctctccagcctacagatgac

SEQ ID NO: 2544 - DNA, 20 bp, Artificial Sequence
  Synthetic oligonucleotide
tctctccagcctacagatga

SEQ ID NO: 2545 - DNA, 20 bp, Artificial Sequence
  Synthetic oligonucleotide
ctctctccagcctacagatg

SEQ ID NO: 2546 - DNA, 20 bp, Artificial Sequence
  Synthetic oligonucleotide
cctctctccagcctacagat

SEQ ID NO: 2547 - DNA, 20 bp, Artificial Sequence
  Synthetic oligonucleotide
tcctctctccagcctacaga

SEQ ID NO: 2548 - DNA, 20 bp, Artificial Sequence
  Synthetic oligonucleotide
ttcctctctccagcctacag

SEQ ID NO: 2549 - DNA, 20 bp, Artificial Sequence
  Synthetic oligonucleotide
gttcctctctccagcctaca

SEQ ID NO: 2550 - DNA, 20 bp, Artificial Sequence
  Synthetic oligonucleotide
agttcctctctccagcctac

SEQ ID NO: 2551 - DNA, 20 bp, Artificial Sequence
  Synthetic oligonucleotide
cagttcctctctccagccta

SEQ ID NO: 2552 - DNA, 20 bp, Artificial Sequence
  Synthetic oligonucleotide
ccagttcctctctccagcct

SEQ ID NO: 2553 - DNA, 20 bp, Artificial Sequence
  Synthetic oligonucleotide
tccagttcctctctccagcc

SEQ ID NO: 2554 - DNA, 20 bp, Artificial Sequence
  Synthetic oligonucleotide
ttccagttcctctctccagc

SEQ ID NO: 2555 - DNA, 20 bp, Artificial Sequence
  Synthetic oligonucleotide
cttccagttcctctctccag

SEQ ID NO: 2556 - DNA, 20 bp, Artificial Sequence
  Synthetic oligonucleotide
ccttccagttcctctctcca

SEQ ID NO: 2557 - DNA, 20 bp, Artificial Sequence
  Synthetic oligonucleotide
cccttccagttcctctctcc

SEQ ID NO: 2558 - DNA, 20 bp, Artificial Sequence
  Synthetic oligonucleotide
ccccttccagttcctctctc

SEQ ID NO: 2559 - DNA, 20 bp, Artificial Sequence
  Synthetic oligonucleotide
gccccttccagttcctctct

SEQ ID NO: 2560 - DNA, 20 bp, Artificial Sequence
  Synthetic oligonucleotide
agccccttccagttcctctc

SEQ ID NO: 2561 - DNA, 20 bp, Artificial Sequence
  Synthetic oligonucleotide
tagccccttccagttcctct

SEQ ID NO: 2562 - DNA, 20 bp, Artificial Sequence
  Synthetic oligonucleotide
ttagccccttccagttcctc

SEQ ID NO: 2563 - DNA, 20 bp, Artificial Sequence
  Synthetic oligonucleotide
tttagccccttccagttcct

SEQ ID NO: 2564 - DNA, 20 bp, Artificial Sequence
  Synthetic oligonucleotide
ctttagccccttccagttcc

SEQ ID NO: 2565 - DNA, 20 bp, Artificial Sequence
  Synthetic oligonucleotide
actttagccccttccagttc

SEQ ID NO: 2566 - DNA, 20 bp, Artificial Sequence
  Synthetic oligonucleotide
aactttagccccttccagtt

SEQ ID NO: 2567 - DNA, 20 bp, Artificial Sequence
  Synthetic oligonucleotide
caactttagccccttccagt

SEQ ID NO: 2568 - DNA, 20 bp, Artificial Sequence
  Synthetic oligonucleotide
ccaactttagccccttccag

SEQ ID NO: 2569 - DNA, 20 bp, Artificial Sequence
  Synthetic oligonucleotide
agccaactttagccccttcc

SEQ ID NO: 2570 - DNA, 20 bp, Artificial Sequence
  Synthetic oligonucleotide
cagccaactttagccccttc

SEQ ID NO: 2571 - DNA, 20 bp, Artificial Sequence
  Synthetic oligonucleotide
tcagccaactttagcccctt

SEQ ID NO: 2572 - DNA, 20 bp, Artificial Sequence
  Synthetic oligonucleotide
ctcagccaactttagcccct

SEQ ID NO: 2573 - DNA, 20 bp, Artificial Sequence
  Synthetic oligonucleotide
actcagccaactttagcccc

SEQ ID NO: 2574 - DNA, 20 bp, Artificial Sequence
  Synthetic oligonucleotide
tactcagccaactttagccc

SEQ ID NO: 2575 - DNA, 20 bp, Artificial Sequence
  Synthetic oligonucleotide
ctactcagccaactttagcc

SEQ ID NO: 2576 - DNA, 20 bp, Artificial Sequence
  Synthetic oligonucleotide
actactcagccaactttagc

SEQ ID NO: 2577 - DNA, 20 bp, Artificial Sequence
  Synthetic oligonucleotide
aactactcagccaactttag

SEQ ID NO: 2578 - DNA, 20 bp, Artificial Sequence
  Synthetic oligonucleotide
taactactcagccaacttta

SEQ ID NO: 2579 - DNA, 20 bp, Artificial Sequence
  Synthetic oligonucleotide
tgtactttacatgtgcagca

SEQ ID NO: 2580 - DNA, 20 bp, Artificial Sequence
  Synthetic oligonucleotide
gtgtactttacatgtgcagc

SEQ ID NO: 2581 - DNA, 20 bp, Artificial Sequence
  Synthetic oligonucleotide
tgtgtactttacatgtgcag

SEQ ID NO: 2582 - DNA, 20 bp, Artificial Sequence
  Synthetic oligonucleotide
ctgtgtactttacatgtgca

SEQ ID NO: 2583 - DNA, 20 bp, Artificial Sequence
  Synthetic oligonucleotide
cctgtgtactttacatgtgc

SEQ ID NO: 2584 - DNA, 20 bp, Artificial Sequence
  Synthetic oligonucleotide
tcctgtgtactttacatgtg

SEQ ID NO: 2585 - DNA, 20 bp, Artificial Sequence
  Synthetic oligonucleotide
ctcctgtgtactttacatgt

SEQ ID NO: 2586 - DNA, 20 bp, Artificial Sequence
  Synthetic oligonucleotide
tctcctgtgtactttacatg

SEQ ID NO: 2587 - DNA, 20 bp, Artificial Sequence
  Synthetic oligonucleotide
atctcctgtgtactttacat

SEQ ID NO: 2588 - DNA, 20 bp, Artificial Sequence
  Synthetic oligonucleotide
aatctcctgtgtactttaca

SEQ ID NO: 2589 - DNA, 20 bp, Artificial Sequence
  Synthetic oligonucleotide
aaatctcctgtgtactttac

SEQ ID NO: 2590 - DNA, 20 bp, Artificial Sequence
  Synthetic oligonucleotide
taaatctcctgtgtacttta

SEQ ID NO: 2591 - DNA, 20 bp, Artificial Sequence
  Synthetic oligonucleotide
ctaaatctcctgtgtacttt

SEQ ID NO: 2592 - DNA, 20 bp, Artificial Sequence
  Synthetic oligonucleotide
tctaaatctcctgtgtactt

SEQ ID NO: 2593 - DNA, 20 bp, Artificial Sequence
  Synthetic oligonucleotide
ttctaaatctcctgtgtact

SEQ ID NO: 2594 - DNA, 20 bp, Artificial Sequence
  Synthetic oligonucleotide
tttctaaatctcctgtgtac

SEQ ID NO: 2595 - DNA, 20 bp, Artificial Sequence
  Synthetic oligonucleotide
ttttctaaatctcctgtgta

SEQ ID NO: 2596 - DNA, 20 bp, Artificial Sequence
  Synthetic oligonucleotide
gttttctaaatctcctgtgt

SEQ ID NO: 2597 - DNA, 20 bp, Artificial Sequence
  Synthetic oligonucleotide
agttttctaaatctcctgtg

SEQ ID NO: 2598 - DNA, 20 bp, Artificial Sequence
  Synthetic oligonucleotide
aagttttctaaatctcctgt

SEQ ID NO: 2599 - DNA, 20 bp, Artificial Sequence
  Synthetic oligonucleotide
gaagttttctaaatctcctg

SEQ ID NO: 2600 - DNA, 20 bp, Artificial Sequence
  Synthetic oligonucleotide
cgaagttttctaaatctcct

SEQ ID NO: 2601 - DNA, 20 bp, Artificial Sequence
  Synthetic oligonucleotide
acgaagttttctaaatctcc

SEQ ID NO: 2602 - DNA, 20 bp, Artificial Sequence
  Synthetic oligonucleotide
tacgaagttttctaaatctc

SEQ ID NO: 2603 - DNA, 20 bp, Artificial Sequence
  Synthetic oligonucleotide
ctacgaagttttctaaatct

SEQ ID NO: 2604 - DNA, 20 bp, Artificial Sequence
  Synthetic oligonucleotide
gctacgaagttttctaaatc

SEQ ID NO: 2605 - DNA, 20 bp, Artificial Sequence
  Synthetic oligonucleotide
tttccaatatttgtaccctc

SEQ ID NO: 2606 - DNA, 20 bp, Artificial Sequence
  Synthetic oligonucleotide
ctttccaatatttgtaccct

SEQ ID NO: 2607 - DNA, 20 bp, Artificial Sequence
  Synthetic oligonucleotide
gctttccaatatttgtaccc

SEQ ID NO: 2608 - DNA, 20 bp, Artificial Sequence
  Synthetic oligonucleotide
tgctttccaatatttgtacc

SEQ ID NO: 2609 - DNA, 20 bp, Artificial Sequence
  Synthetic oligonucleotide
ttgctttccaatatttgtac

SEQ ID NO: 2610 - DNA, 20 bp, Artificial Sequence
  Synthetic oligonucleotide
cttgctttccaatatttgta

SEQ ID NO: 2611 - DNA, 20 bp, Artificial Sequence
  Synthetic oligonucleotide
ccttgctttccaatatttgt

SEQ ID NO: 2612 - DNA, 20 bp, Artificial Sequence
  Synthetic oligonucleotide
cccttgctttccaatatttg

SEQ ID NO: 2613 - DNA, 20 bp, Artificial Sequence
  Synthetic oligonucleotide
tcccttgctttccaatattt

SEQ ID NO: 2614 - DNA, 20 bp, Artificial Sequence
  Synthetic oligonucleotide
gtcccttgctttccaatatt

SEQ ID NO: 2615 - DNA, 20 bp, Artificial Sequence
  Synthetic oligonucleotide
tgtcccttgctttccaatat

SEQ ID NO: 2616 - DNA, 20 bp, Artificial Sequence
  Synthetic oligonucleotide
ctgtcccttgctttccaata

SEQ ID NO: 2617 - DNA, 20 bp, Artificial Sequence
  Synthetic oligonucleotide
tctgtcccttgctttccaat

SEQ ID NO: 2618 - DNA, 20 bp, Artificial Sequence
  Synthetic oligonucleotide
ttctgtcccttgctttccaa

SEQ ID NO: 2619 - DNA, 20 bp, Artificial Sequence
  Synthetic oligonucleotide
gtttccagatattttcccat

SEQ ID NO: 2620 - DNA, 20 bp, Artificial Sequence
  Synthetic oligonucleotide
tgtttccagatattttccca

SEQ ID NO: 2621 - DNA, 20 bp, Artificial Sequence
  Synthetic oligonucleotide
ctttccattctagttttacc

SEQ ID NO: 2622 - DNA, 20 bp, Artificial Sequence
  Synthetic oligonucleotide
actttccattctagttttac

SEQ ID NO: 2623 - DNA, 20 bp, Artificial Sequence
  Synthetic oligonucleotide
cactttccattctagtttta

SEQ ID NO: 2624 - DNA, 20 bp, Artificial Sequence
  Synthetic oligonucleotide
acactttccattctagtttt

SEQ ID NO: 2625 - DNA, 20 bp, Artificial Sequence
  Synthetic oligonucleotide
cacactttccattctagttt

SEQ ID NO: 2626 - DNA, 20 bp, Artificial Sequence
  Synthetic oligonucleotide
ccacactttccattctagtt

SEQ ID NO: 2627 - DNA, 20 bp, Artificial Sequence
  Synthetic oligonucleotide
agccacactttccattctag

SEQ ID NO: 2628 - DNA, 20 bp, Artificial Sequence
  Synthetic oligonucleotide
aagccacactttccattcta

SEQ ID NO: 2629 - DNA, 20 bp, Artificial Sequence
  Synthetic oligonucleotide
caagccacactttccattct

SEQ ID NO: 2630 - DNA, 20 bp, Artificial Sequence
  Synthetic oligonucleotide
tcaagccacactttccattc

SEQ ID NO: 2631 - DNA, 20 bp, Artificial Sequence
  Synthetic oligonucleotide
ctcaagccacactttccatt

SEQ ID NO: 2632 - DNA, 20 bp, Artificial Sequence
  Synthetic oligonucleotide
gctcaagccacactttccat

SEQ ID NO: 2633 - DNA, 20 bp, Artificial Sequence
  Synthetic oligonucleotide
agctcaagccacactttcca

SEQ ID NO: 2634 - DNA, 20 bp, Artificial Sequence
  Synthetic oligonucleotide
cagctcaagccacactttcc

SEQ ID NO: 2635 - DNA, 20 bp, Artificial Sequence
  Synthetic oligonucleotide
ccagctcaagccacactttc

SEQ ID NO: 2636 - DNA, 20 bp, Artificial Sequence
  Synthetic oligonucleotide
accagctcaagccacacttt

SEQ ID NO: 2637 - DNA, 20 bp, Artificial Sequence
  Synthetic oligonucleotide
taccagctcaagccacactt

SEQ ID NO: 2638 - DNA, 20 bp, Artificial Sequence
  Synthetic oligonucleotide
ttaccagctcaagccacact

SEQ ID NO: 2639 - DNA, 20 bp, Artificial Sequence
  Synthetic oligonucleotide
gttaccagctcaagccacac

SEQ ID NO: 2640 - DNA, 20 bp, Artificial Sequence
  Synthetic oligonucleotide
ggttaccagctcaagccaca

SEQ ID NO: 2641 - DNA, 20 bp, Artificial Sequence
  Synthetic oligonucleotide
tcccacagtgacagtgactc

SEQ ID NO: 2642 - DNA, 20 bp, Artificial Sequence
  Synthetic oligonucleotide
ttcccacagtgacagtgact

SEQ ID NO: 2643 - DNA, 20 bp, Artificial Sequence
  Synthetic oligonucleotide
cttcccacagtgacagtgac

SEQ ID NO: 2644 - DNA, 20 bp, Artificial Sequence
  Synthetic oligonucleotide
taccagttttctagccgatc

SEQ ID NO: 2645 - DNA, 20 bp, Artificial Sequence
  Synthetic oligonucleotide
ttaccagttttctagccgat

SEQ ID NO: 2646 - DNA, 20 bp, Artificial Sequence
  Synthetic oligonucleotide
tttaccagttttctagccga

SEQ ID NO: 2647 - DNA, 20 bp, Artificial Sequence
  Synthetic oligonucleotide
ctttaccagttttctagccg

SEQ ID NO: 2648 - DNA, 20 bp, Artificial Sequence
  Synthetic oligonucleotide
cctttaccagttttctagcc

SEQ ID NO: 2649 - DNA, 20 bp, Artificial Sequence
  Synthetic oligonucleotide
tcctttaccagttttctagc

SEQ ID NO: 2650 - DNA, 20 bp, Artificial Sequence
  Synthetic oligonucleotide
atcctttaccagttttctag

SEQ ID NO: 2651 - DNA, 20 bp, Artificial Sequence
  Synthetic oligonucleotide
catcctttaccagttttcta

SEQ ID NO: 2652 - DNA, 20 bp, Artificial Sequence
  Synthetic oligonucleotide
tcatcctttaccagttttct

SEQ ID NO: 2653 - DNA, 20 bp, Artificial Sequence
  Synthetic oligonucleotide
ttcatcctttaccagttttc

SEQ ID NO: 2654 - DNA, 20 bp, Artificial Sequence
  Synthetic oligonucleotide
tttcatcctttaccagtttt

SEQ ID NO: 2655 - DNA, 20 bp, Artificial Sequence
  Synthetic oligonucleotide
ctttcatcctttaccagttt

SEQ ID NO: 2656 - DNA, 20 bp, Artificial Sequence
  Synthetic oligonucleotide
tctttcatcctttaccagtt

SEQ ID NO: 2657 - DNA, 20 bp, Artificial Sequence
  Synthetic oligonucleotide
ttctttcatcctttaccagt

SEQ ID NO: 2658 - DNA, 20 bp, Artificial Sequence
  Synthetic oligonucleotide
cttctttcatcctttaccag

SEQ ID NO: 2659 - DNA, 20 bp, Artificial Sequence
  Synthetic oligonucleotide
gcttctttcatcctttacca

SEQ ID NO: 2660 - DNA, 20 bp, Artificial Sequence
  Synthetic oligonucleotide
agcttctttcatcctttacc

SEQ ID NO: 2661 - DNA, 20 bp, Artificial Sequence
  Synthetic oligonucleotide
aagcttctttcatcctttac

SEQ ID NO: 2662 - DNA, 20 bp, Artificial Sequence
  Synthetic oligonucleotide
aaagcttctttcatccttta

SEQ ID NO: 2663 - DNA, 20 bp, Artificial Sequence
  Synthetic oligonucleotide
aaaagcttctttcatccttt

SEQ ID NO: 2664 - DNA, 20 bp, Artificial Sequence
  Synthetic oligonucleotide
gaaaagcttctttcatcctt

SEQ ID NO: 2665 - DNA, 20 bp, Artificial Sequence
  Synthetic oligonucleotide
ggaaaagcttctttcatcct

SEQ ID NO: 2666 - DNA, 20 bp, Artificial Sequence
  Synthetic oligonucleotide
accaagtgtttgaattctgc

SEQ ID NO: 2667 - DNA, 20 bp, Artificial Sequence
  Synthetic oligonucleotide
taccaagtgtttgaattctg

SEQ ID NO: 2668 - DNA, 20 bp, Artificial Sequence
  Synthetic oligonucleotide
ataccaagtgtttgaattct

SEQ ID NO: 2669 - DNA, 20 bp, Artificial Sequence
  Synthetic oligonucleotide
cataccaagtgtttgaattc

SEQ ID NO: 2670 - DNA, 20 bp, Artificial Sequence
  Synthetic oligonucleotide
acataccaagtgtttgaatt

SEQ ID NO: 2671 - DNA, 20 bp, Artificial Sequence
  Synthetic oligonucleotide
cacataccaagtgtttgaat

SEQ ID NO: 2672 - DNA, 20 bp, Artificial Sequence
  Synthetic oligonucleotide
ccacataccaagtgtttgaa

SEQ ID NO: 2673 - DNA, 20 bp, Artificial Sequence
  Synthetic oligonucleotide
cccacataccaagtgtttga

SEQ ID NO: 2674 - DNA, 20 bp, Artificial Sequence
  Synthetic oligonucleotide
tcccacataccaagtgtttg

SEQ ID NO: 2675 - DNA, 20 bp, Artificial Sequence
  Synthetic oligonucleotide
ctcccacataccaagtgttt

SEQ ID NO: 2676 - DNA, 20 bp, Artificial Sequence
  Synthetic oligonucleotide
cctcccacataccaagtgtt

SEQ ID NO: 2677 - DNA, 20 bp, Artificial Sequence
  Synthetic oligonucleotide
tcctcccacataccaagtgt

SEQ ID NO: 2678 - DNA, 20 bp, Artificial Sequence
  Synthetic oligonucleotide
ctcctcccacataccaagtg

SEQ ID NO: 2679 - DNA, 20 bp, Artificial Sequence
  Synthetic oligonucleotide
gctcctcccacataccaagt

SEQ ID NO: 2680 - DNA, 20 bp, Artificial Sequence
  Synthetic oligonucleotide
agctcctcccacataccaag

SEQ ID NO: 2681 - DNA, 20 bp, Artificial Sequence
  Synthetic oligonucleotide
gagctcctcccacataccaa

SEQ ID NO: 2682 - DNA, 20 bp, Artificial Sequence
  Synthetic oligonucleotide
cagtctagaatagccatgga

SEQ ID NO: 2683 - DNA, 20 bp, Artificial Sequence
  Synthetic oligonucleotide
acagtctagaatagccatgg

SEQ ID NO: 2684 - DNA, 20 bp, Artificial Sequence
  Synthetic oligonucleotide
gacagtctagaatagccatg

SEQ ID NO: 2685 - DNA, 20 bp, Artificial Sequence
  Synthetic oligonucleotide
agacagtctagaatagccat

SEQ ID NO: 2686 - DNA, 20 bp, Artificial Sequence
  Synthetic oligonucleotide
gagacagtctagaatagcca

SEQ ID NO: 2687 - DNA, 20 bp, Artificial Sequence
  Synthetic oligonucleotide
agagacagtctagaatagcc

SEQ ID NO: 2688 - DNA, 20 bp, Artificial Sequence
  Synthetic oligonucleotide
cagagacagtctagaatagc

SEQ ID NO: 2689 - DNA, 20 bp, Artificial Sequence
  Synthetic oligonucleotide
acagagacagtctagaatag

SEQ ID NO: 2690 - DNA, 20 bp, Artificial Sequence
  Synthetic oligonucleotide
cacagagacagtctagaata

SEQ ID NO: 2691 - DNA, 20 bp, Artificial Sequence
  Synthetic oligonucleotide
tcacagagacagtctagaat

SEQ ID NO: 2692 - DNA, 20 bp, Artificial Sequence
  Synthetic oligonucleotide
atcacagagacagtctagaa

SEQ ID NO: 2693 - DNA, 20 bp, Artificial Sequence
  Synthetic oligonucleotide
tatcacagagacagtctaga

SEQ ID NO: 2694 - DNA, 20 bp, Artificial Sequence
  Synthetic oligonucleotide
atatcacagagacagtctag

SEQ ID NO: 2695 - DNA, 20 bp, Artificial Sequence
  Synthetic oligonucleotide
aatatcacagagacagtcta

SEQ ID NO: 2696 - DNA, 20 bp, Artificial Sequence
  Synthetic oligonucleotide
aaatatcacagagacagtct

SEQ ID NO: 2697 - DNA, 20 bp, Artificial Sequence
  Synthetic oligonucleotide
gcaaatatcacagagacagt

SEQ ID NO: 2698 - DNA, 20 bp, Artificial Sequence
  Synthetic oligonucleotide
tgcaaatatcacagagacag

SEQ ID NO: 2699 - DNA, 20 bp, Artificial Sequence
  Synthetic oligonucleotide
atgcaaatatcacagagaca

SEQ ID NO: 2700 - DNA, 20 bp, Artificial Sequence
  Synthetic oligonucleotide
aatgcaaatatcacagagac

SEQ ID NO: 2701 - DNA, 20 bp, Artificial Sequence
  Synthetic oligonucleotide
aaatgcaaatatcacagaga

SEQ ID NO: 2702 - DNA, 20 bp, Artificial Sequence
  Synthetic oligonucleotide
aaaatgcaaatatcacagag

SEQ ID NO: 2703 - DNA, 20 bp, Artificial Sequence
  Synthetic oligonucleotide
taaaatgcaaatatcacaga

SEQ ID NO: 2704 - DNA, 20 bp, Artificial Sequence
  Synthetic oligonucleotide
ttaaaatgcaaatatcacag

SEQ ID NO: 2705 - DNA, 20 bp, Artificial Sequence
  Synthetic oligonucleotide
tttaaaatgcaaatatcaca

SEQ ID NO: 2706 - DNA, 20 bp, Artificial Sequence
  Synthetic oligonucleotide
gtttaaaatgcaaatatcac

SEQ ID NO: 2707 - DNA, 20 bp, Artificial Sequence
  Synthetic oligonucleotide
agtttaaaatgcaaatatca

SEQ ID NO: 2708 - DNA, 20 bp, Artificial Sequence
  Synthetic oligonucleotide
cagtttaaaatgcaaatatc

SEQ ID NO: 2709 - DNA, 20 bp, Artificial Sequence
  Synthetic oligonucleotide
tcagtttaaaatgcaaatat

SEQ ID NO: 2710 - DNA, 20 bp, Artificial Sequence
  Synthetic oligonucleotide
ttcagtttaaaatgcaaata

SEQ ID NO: 2711 - DNA, 20 bp, Artificial Sequence
  Synthetic oligonucleotide
attcagtttaaaatgcaaat

SEQ ID NO: 2712 - DNA, 20 bp, Artificial Sequence
  Synthetic oligonucleotide
tattcagtttaaaatgcaaa

SEQ ID NO: 2713 - DNA, 20 bp, Artificial Sequence
  Synthetic oligonucleotide
atattcagtttaaaatgcaa

SEQ ID NO: 2714 - DNA, 20 bp, Artificial Sequence
  Synthetic oligonucleotide
acatggttatgtgtatctgc

SEQ ID NO: 2715 - DNA, 20 bp, Artificial Sequence
  Synthetic oligonucleotide
cacatggttatgtgtatctg

SEQ ID NO: 2716 - DNA, 20 bp, Artificial Sequence
  Synthetic oligonucleotide
ccacatggttatgtgtatct

SEQ ID NO: 2717 - DNA, 20 bp, Artificial Sequence
  Synthetic oligonucleotide
agtacaattgcttcaactag

SEQ ID NO: 2718 - DNA, 20 bp, Artificial Sequence
  Synthetic oligonucleotide
cagtacaattgcttcaacta

SEQ ID NO: 2719 - DNA, 20 bp, Artificial Sequence
  Synthetic oligonucleotide
gcagtacaattgcttcaact

SEQ ID NO: 2720 - DNA, 20 bp, Artificial Sequence
  Synthetic oligonucleotide
ggcagtacaattgcttcaac

SEQ ID NO: 2721 - DNA, 20 bp, Artificial Sequence
  Synthetic oligonucleotide
ctccttaaaccttcctattt

SEQ ID NO: 2722 - DNA, 20 bp, Artificial Sequence
  Synthetic oligonucleotide
ttctccttaaaccttcctat

SEQ ID NO: 2723 - DNA, 20 bp, Artificial Sequence
  Synthetic oligonucleotide
gattctccttaaaccttcct

SEQ ID NO: 2724 - DNA, 20 bp, Artificial Sequence
  Synthetic oligonucleotide
tagattctccttaaaccttc

SEQ ID NO: 2725 - DNA, 20 bp, Artificial Sequence
  Synthetic oligonucleotide
cttagattctccttaaacct

SEQ ID NO: 2726 - DNA, 20 bp, Artificial Sequence
  Synthetic oligonucleotide
tgcttagattctccttaaac

SEQ ID NO: 2727 - DNA, 20 bp, Artificial Sequence
  Synthetic oligonucleotide
aatgcttagattctccttaa

SEQ ID NO: 2728 - DNA, 20 bp, Artificial Sequence
  Synthetic oligonucleotide
aaaatgcttagattctcctt

SEQ ID NO: 2729 - DNA, 20 bp, Artificial Sequence
  Synthetic oligonucleotide
tcaaggttgtaagcaccctc

SEQ ID NO: 2730 - DNA, 20 bp, Artificial Sequence
  Synthetic oligonucleotide
agtcaaggttgtaagcaccc

SEQ ID NO: 2731 - DNA, 20 bp, Artificial Sequence
  Synthetic oligonucleotide
agcagatcaagtccagggag

SEQ ID NO: 2732 - DNA, 20 bp, Artificial Sequence
  Synthetic oligonucleotide
acagcagatcaagtccaggg

SEQ ID NO: 2733 - DNA, 20 bp, Artificial Sequence
  Synthetic oligonucleotide
aggtgttcccatacgcacag

SEQ ID NO: 2734 - DNA, 20 bp, Artificial Sequence
  Synthetic oligonucleotide
ctaggtgttcccatacgcac

SEQ ID NO: 2735 - DNA, 20 bp, Artificial Sequence
  Synthetic oligonucleotide
tgctaggtgttcccatacgc

SEQ ID NO: 2736 - DNA, 20 bp, Artificial Sequence
  Synthetic oligonucleotide
caactgtctccaggcaggag

SEQ ID NO: 2737 - DNA, 20 bp, Artificial Sequence
  Synthetic oligonucleotide
atcaactgtctccaggcagg

SEQ ID NO: 2738 - DNA, 20 bp, Artificial Sequence
  Synthetic oligonucleotide
acatcaactgtctccaggca

SEQ ID NO: 2739 - DNA, 20 bp, Artificial Sequence
  Synthetic oligonucleotide
acacatcaactgtctccagg

SEQ ID NO: 2740 - DNA, 20 bp, Artificial Sequence
  Synthetic oligonucleotide
gtactgaagagtgttgctgg

SEQ ID NO: 2741 - DNA, 20 bp, Artificial Sequence
  Synthetic oligonucleotide
atgtactgaagagtgttgct

SEQ ID NO: 2742 - DNA, 20 bp, Artificial Sequence
  Synthetic oligonucleotide
aaacccaatggtaagcccaa

SEQ ID NO: 2743 - DNA, 20 bp, Artificial Sequence
  Synthetic oligonucleotide
ttaaacccaatggtaagccc

SEQ ID NO: 2744 - DNA, 20 bp, Artificial Sequence
  Synthetic oligonucleotide
ctacaatcagagttaagacc

SEQ ID NO: 2745 - DNA, 20 bp, Artificial Sequence
  Synthetic oligonucleotide
tgctacaatcagagttaaga

SEQ ID NO: 2746 - DNA, 20 bp, Artificial Sequence
  Synthetic oligonucleotide
ctcctctcagaacttttgct

SEQ ID NO: 2747 - DNA, 20 bp, Artificial Sequence
  Synthetic oligonucleotide
agctcctctcagaacttttg

SEQ ID NO: 2748 - DNA, 20 bp, Artificial Sequence
  Synthetic oligonucleotide
tcagctcctctcagaacttt

SEQ ID NO: 2749 - DNA, 20 bp, Artificial Sequence
  Synthetic oligonucleotide
ggtaggtaagcaacccacgg

SEQ ID NO: 2750 - DNA, 20 bp, Artificial Sequence
  Synthetic oligonucleotide
taggtaggtaagcaacccac

SEQ ID NO: 2751 - DNA, 20 bp, Artificial Sequence
  Synthetic oligonucleotide
agcttataaaccaccttata

SEQ ID NO: 2752 - DNA, 20 bp, Artificial Sequence
  Synthetic oligonucleotide
gcagcttataaaccacctta

SEQ ID NO: 2753 - DNA, 20 bp, Artificial Sequence
  Synthetic oligonucleotide
cagcagcttataaaccacct

SEQ ID NO: 2754 - DNA, 20 bp, Artificial Sequence
  Synthetic oligonucleotide
ggccaggacagcagcttata

SEQ ID NO: 2755 - DNA, 20 bp, Artificial Sequence
  Synthetic oligonucleotide
gtggccaggacagcagctta

SEQ ID NO: 2756 - DNA, 20 bp, Artificial Sequence
  Synthetic oligonucleotide
ggaatttgaatgcagtggcc

SEQ ID NO: 2757 - DNA, 20 bp, Artificial Sequence
  Synthetic oligonucleotide
ttggaatttgaatgcagtgg

SEQ ID NO: 2758 - DNA, 27 bp, Artificial Sequence
  Synthetic oligonucleotide
gcgtttgctcttcttcttgcgtttttt

What is claimed is:

1. A compound comprising a single-stranded modified oligonucleotide consisting of 16 linked nucleosides having a nucleobase sequence consisting of the sequence of SEQ ID NO: 245, or a pharmaceutically acceptable salt thereof, wherein the modified oligonucleotide comprises:
   a gap segment consisting of ten linked deoxynucleosides;
   a 5' wing segment consisting of 3 linked nucleosides; and
   a 3' wing segment consisting of 3 linked nucleosides;
   wherein the gap segment is positioned between the 5' wing segment and the 3' wing segment;
   wherein each nucleoside of each wing segment comprises a constrained ethyl nucleoside;
   wherein each internucleoside linkage of the modified oligonucleotide is a phosphorothioate linkage; and
   wherein each cytosine of the modified oligonucleotide is a 5'-methylcytosine.

2. A method of treating cancer in an animal, comprising administering to the animal the compound of claim 1, or a pharmaceutical salt thereof, thereby treating the cancer.

3. The method of claim 2, wherein administering the compound, or a pharmaceutical salt thereof, reduces tumor size in the animal.

4. The method of claim 2, wherein administering the compound, or a pharmaceutical salt thereof, reduces tumor volume in the animal.

5. The method of claim 2, wherein administering the compound, or a pharmaceutical salt thereof, prolongs survival of the animal.

6. A method of reducing expression of STAT3 in an animal, comprising administering to the animal the compound of claim 1, or a pharmaceutical salt thereof.

7. A composition comprising the compound of claim 1, or a pharmaceutical salt thereof, and a pharmaceutically acceptable diluent or carrier.

8. A method of treating cancer in an animal, comprising administering to the animal the composition of claim 7, thereby treating the cancer.

9. The method of claim 8, wherein administering the composition reduces tumor size in the animal.

10. The method of claim 8, wherein administering the composition reduces tumor volume in the animal.

11. The method of claim 8, wherein administering the composition prolongs survival of the animal.

12. The method of claim 8, wherein the animal is a human.

13. The method of claim 2, wherein the animal is a human.

14. The compound of claim 1, or a pharmaceutical salt thereof, wherein the oligonucleotide is covalently linked to a conjugate.

15. The compound of claim 14, or a pharmaceutical salt thereof, wherein the conjugate comprises a carbohydrate group.

16. A composition comprising the compound of claim 14, or a pharmaceutical salt thereof, and a pharmaceutically acceptable diluent or carrier.

17. A composition comprising the compound of claim 15, or a pharmaceutical salt thereof, and a pharmaceutically acceptable diluent or carrier.

* * * * *